(12) United States Patent
Abudayyeh et al.

(10) Patent No.: US 11,021,740 B2
(45) Date of Patent: *Jun. 1, 2021

(54) DEVICES FOR CRISPR EFFECTOR SYSTEM BASED DIAGNOSTICS

(71) Applicants: THE BROAD INSTITUTE, INC., Cambridge, MA (US); MASSACHUSETTS INSTITUTE OF TECHNOLOGY, Cambridge, MA (US); PRESIDENT AND FELLOWS OF HARVARD COLLEGE, Cambridge, MA (US)

(72) Inventors: Omar Abudayyeh, Cambridge, MA (US); James Joseph Collins, Newton, MA (US); Jonathan Gootenberg, Cambridge, MA (US); Feng Zhang, Cambridge, MA (US); Eric S. Lander, Cambridge, MA (US)

(73) Assignees: The Broad Institute, Inc., Cambridge, MA (US); Massachusetts Institute of Technology, Cambridge, MA (US); President and Fellows of Harvard College, Cambridge, MA (US)

( * ) Notice: Subject to any disclaimer, the term of this patent is extended or adjusted under 35 U.S.C. 154(b) by 202 days.

This patent is subject to a terminal disclaimer.

(21) Appl. No.: 15/922,837

(22) Filed: Mar. 15, 2018

(65) Prior Publication Data

US 2019/0144929 A1    May 16, 2019

Related U.S. Application Data

(60) Provisional application No. 62/471,940, filed on Mar. 15, 2017, provisional application No. 62/484,859, filed on Apr. 12, 2017, provisional application No. 62/568,268, filed on Oct. 4, 2017.

(51) Int. Cl.

| | | |
|---|---|---|
| *C12Q 1/6832* | (2018.01) | |
| *C12N 15/11* | (2006.01) | |
| *C12N 9/22* | (2006.01) | |
| *C12N 9/96* | (2006.01) | |
| *C12Q 1/6816* | (2018.01) | |
| *C12Q 1/6823* | (2018.01) | |
| *G01N 33/558* | (2006.01) | |
| *B01L 3/00* | (2006.01) | |
| *B01L 7/00* | (2006.01) | |
| *C12Q 1/6879* | (2018.01) | |
| *C12Q 1/6827* | (2018.01) | |
| *C12Q 1/682* | (2018.01) | |
| *C12Q 1/6876* | (2018.01) | |

(52) U.S. Cl.
CPC .......... *C12Q 1/6832* (2013.01); *B01L 3/5023* (2013.01); *B01L 7/52* (2013.01); *C12N 9/22* (2013.01); *C12N 9/96* (2013.01); *C12N 15/11* (2013.01); *C12Q 1/682* (2013.01); *C12Q 1/6816* (2013.01); *C12Q 1/6823* (2013.01); *C12Q 1/6827* (2013.01); *C12Q 1/6876* (2013.01); *G01N 33/558* (2013.01); *B01L 2300/0825* (2013.01); *C12N 2310/20* (2017.05)

(58) Field of Classification Search
None
See application file for complete search history.

(56) References Cited

U.S. PATENT DOCUMENTS

| | | |
|---|---|---|
| 7,057,026 B2 | 6/2006 | Barnes et al. |
| 7,211,414 B2 | 5/2007 | Hardin et al. |
| 7,315,019 B2 | 1/2008 | Turner et al. |
| 7,329,492 B2 | 2/2008 | Hardin et al. |
| 7,405,281 B2 | 7/2008 | Xu et al. |
| 9,470,699 B2 | 10/2016 | Peeters |
| 2008/0108082 A1 | 5/2008 | Rank et al. |
| 2011/0111517 A1 | 5/2011 | Siegel et al. |
| 2012/0238008 A1 | 9/2012 | Henry et al. |
| 2014/0356867 A1 | 12/2014 | Peter et al. |
| 2015/0065821 A1 | 3/2015 | Conrad |
| 2015/0342509 A1 | 12/2015 | Peeters et al. |

(Continued)

FOREIGN PATENT DOCUMENTS

| | | |
|---|---|---|
| WO | 91/06678 A1 | 5/1991 |
| WO | 2004/018497 A2 | 3/2004 |

(Continued)

OTHER PUBLICATIONS

Chien et al., "A RFID Tab Based Remote DNA sensing System" Proceedings of the 1st IEEE International Conference on Nano? micro Engineered and Molecular Systems 278-282 (Jan. 2016).*

(Continued)

*Primary Examiner* — Nancy J Leith

(74) *Attorney, Agent, or Firm* — Johnson, Marcou, Issacs & Nix, LLC; F. Brent Nix, Esq.; Rachel D. Rutledge, Esq.

(57) ABSTRACT

The embodiments disclosed herein utilized RNA targeting effectors to provide a robust CRISPR-based diagnostic with attomolar sensitivity. Embodiments disclosed herein can detect broth DNA and RNA with comparable levels of sensitivity and can differentiate targets from non-targets based on single base pair differences. Moreover, the embodiments disclosed herein can be prepared in freeze-dried format for convenient distribution and point-of-care (POC) applications. Such embodiments are useful in multiple scenarios in human health including, for example, viral detection, bacterial strain typing, sensitive genotyping, and detection of disease-associated cell free DNA.

28 Claims, 116 Drawing Sheets

Specification includes a Sequence Listing.

(56) References Cited

U.S. PATENT DOCUMENTS

| | | | |
|---|---|---|---|
| 2017/0321198 A1* | 11/2017 | Severinov | C12N 9/22 |
| 2017/0362644 A1* | 12/2017 | Doudna | C12Q 1/6823 |
| 2019/0256900 A1 | 8/2019 | Zhang et al. | |

FOREIGN PATENT DOCUMENTS

| | | |
|---|---|---|
| WO | 2007/123744 A2 | 11/2007 |
| WO | 2013/071301 A1 | 5/2013 |
| WO | 2017/219027 A1 | 12/2017 |

OTHER PUBLICATIONS

Sorek et al., "CRISPR-Mediated Adaptive Immune Systems in Bacteria and Archaea" 82 Annual Review of Biochemistry 237-266 (2013).*

Wieland et al., "RNA Quadruplex-Based Modulation of Gene Expression" 14 Chemistry & Biology 757-763 (2007).*

Liu et al., "Recent Progress of Microfluidics in Translational Applications" 5(8) Advanced Healthcare Materials 871-888, Author Manuscript 1-33 (Apr. 2016).*

Abudayyeh, et al., "C2c2 is a Single-Component Programmable RNA-Guided RNA-Targeting CRISPR Effector", Science, vol. 353, No. 6299, Aug. 5, 2016, 11 pages.

Allerson, et al., "Fully 2'-Modified Oligonucleotide Duplexes with Improved in Vitro Potency and Stability Compared to Unmodified Small Interfering RNA", Journal of Medicinal Chemistry, vol. 48, No. 4, 2005, 901-904.

Barletta, et al., "Lowering the Detection Limits of HIV-1 Viral Load Using Real-Time Immuno-PCR for HIV-1 p24 Antigen", American Journal of Clinical Pathology, vol. 122, 2004, 20-27.

Barzon, et al., "Zika Virus: from Pathogenesis to Disease Control", FEMS Microbiol Letters, vol. 363, No. 18, 2016, 43 pages.

Bentley, et al., "Accurate Whole Human Genome Sequencing using Reversible Terminator Chemistry", Nature, vol. 456, No. 7218, Nov. 6, 2008, 53-59.

Bettegowda, et al., "Detection of Circulating Tumor DNA in Early- and Late-Stage Human Malignancies", Science Translational Medicine, vol. 6, No. 224, Feb. 2014, 1-25.

Bramsen, et al., "Development of Therapeutic-Grade Small Interfering RNAs by Chemical Engineering", Frontiers in Genetics, vol. 3, Article 154, Aug. 2012, 22 pages.

Chavez, et al., "Comparative Analysis of Cas9 Activators Across Multiple Species", Nature Methods, vol. 13, No. 7, Jul. 2016, 563-567.

Compton, J., "Nucleic Acid Sequence-based Amplification", Nature, vol. 350, No. 6313, 1991, 91-92.

Das et al., "Ultra-Portable, Wireless Smartphone Spectrophotometer for Rapid, Non-Destructive Testing of Fruit Ripeness", Nature Scientific Reports, vol. 6, No. 32504, Sep. 2016, 8 pages.

Dejnirattisai, et al., "Dengue Virus Sero-cross-reactivity Drives Antibody-dependent Enhancement of Infection with Zika Virus", Nature Immunology, vol. 17, No. 9, Sep. 2016, 1102-1108.

Deng, et al., "CASFISH: CRISPR/Cas9-mediated in Situ Labeling of Genomic Loci in Fixed Cells", Proceedings of the National Academy of Sciences, vol. 112, No. 38, 2015, 11870-11875.

Du, et al., "Coupling Sensitive Nucleic Acid Amplification with Commercial Pregnancy Test Strips", Angewandte Chemie International Edition in Englis, vol. 56, No. 4, Jan. 19, 2019, 992-996.

East-Seletsky, et al., "Two Distinct RNase Activities of CRISPR-C2c2 Enable Guide—RNA Processing and RNA Detection", Nature, vol. 538, No. 7624, Oct. 13, 2016, 270-273.

Emmadi, et al., "Molecular Methods and Platforms for Infectious Diseases Testing a Review of FDA-Approved and Cleared Assays", The Journal of Molecular Diagnostics, vol. 13, No. 6, Nov. 2011, 583-604.

Eriksson, et al., "Web-Based, Participant-Driven Studies Yield Novel Genetic Associations for Common Traits", PLOS Genetics, vol. 6, No. 6, 2010, 20 pages.

Gourinat, et al., "Detection of Zika Virus in Urine", Emerging Infectious Diseases, vol. 21, No. 1, Jan. 2015, 84-86.

Green, et al., "Toehold Switches: De-Novo-Designed Regulators of Gene Expression", Cell, vol. 159, No. 4, Nov. 6, 2014, 925-939.

Gupta, et al., "Carbapenem-Resistant Enterobacteriaceae: Epidemiology and Prevention", Clinical Infectious Diseases, vol. 53, No. 1, Jul. 2011, 60-67.

Hale, et al., "RNA-Guided RNA Cleavage by a CRISPR RNA-Cas Protein Complex", Cell, vol. 139, No. 5, Nov. 25, 2009, 945-956.

Hale, et al., "Target RNA Capture and Cleavage by the Cmr Type III-B CRISPR-Cas Effector Complex", Genes & Development, vol. 28, No. 21, Sep. 29, 2014, 2432-2443.

Hendel, et al., "Chemically Modified Guide RNAs Enhance CRISPR-Cas Genome Editing in Human Primary Cells", Nature Biotechnology, vol. 33, No. 9, Sep. 2015, 985-989.

Hou, et al., "Direct Detection and Drug-Resistance Profiling of Bacteremias Using Inertial Microfluidics", Lab Chip, vol. 15, No. 10, May 21, 2015, 2297-2307.

Kelley, et al., "Versatility of chemically synthesized guide RNAs for CRISPR-Cas9 genome editing", Journal of Biotechnology, vol. 233, Jun. 2016, 74-83.

Kumar, et al., "Deconstructing Transcriptional Heterogeneity in Pluripotent Stem Cells", Nature. vol. 516, Dec. 4, 2014, 56-61.

Lanciotti, et al., "Genetic and Serologic Properties of Zika Virus Associated with an Epidemic, Yap State, Micronesia, 2007", Emerging Infectious Disease, vol. 14, No. 8, Aug. 2008, 1232-1239.

Lee, et al., "Synthetically Modified Guide RNA and Donor DNA are a Versatile Platform for CRISPR-Cas9 Engineering", eLIFE, vol. 6, 2017, 23 pages.

Li, et al., "Engineering CRISPR-Cpf1 CrRNAs and MRNAs to Maximize Genome Editing Efficiency", Nature Biomedical Engineering, vol. 1, No. 5, May 2017, 21 pages.

Lu, et al., "Advancing Bacteriophage-Based Microbial Diagnostics With Synthetic Biology", Trends In Biotechnology, vol. 31, No. 6, Jun. 2013, 325-327.

Newman, et al., "An Ultrasensitive Method for Quantitating Circulating Tumor DNA with Broad Patient Coverage", Nature Medicine, vol. 20, No. 5, May 2014, 548-554.

Olmedillas-Lopez, et al., "KRAS G12V Mutation Detection by Droplet Digital PCR in Circulating Cell-Free DNA of Colorectal Cancer Patients", International Journal of Molecular Sciences, vol. 17, No. 4, Apr. 2016, 9 pages.

Pardee, et al., "Paper-Based Synthetic Gene Networks", Cell, vol. 159, No. 4, 2014, 950-954.

Pardee, et al., "Rapid, Low-Cost Detection of Zika Virus Using Programmable Biomolecular Components", Cell, vol. 165, No. 5, May 19, 2016, 1255-1266.

Peng, et al., "An Archaeal CRISPR Type III-B System Exhibiting Distinctive RNA Targeting Features and Mediating Dual RNA and DNA Interference", Nucleic Acids Research, vol. 43, No. 1, Jan. 2015, 406-417.

Piepenburg, et al., "DNA Detection Using Recombination Proteins", PLOS Biology, vol. 4, Issue 7, Jun. 13, 2006, 1115-1121.

Qin, et al., "Cell-free Circulating Tumor DNA in Cancer", Chinese Journal of Cancer, vol. 35, No. 36, 2016, 1-9.

Rahdar, et al., "Synthetic CRISPR RNA-Cas9-guided Genome Editing in Human Cells", Proceedings of the National Academy of Sciences, vol. 112, No. 51, Dec. 22, 2015, E7110-E7117.

Rissin, et al., "Single-Molecule Enzyme-Linked Immunosorbent Assay Detects Serum Proteins at Subfemtomolar Concentrations", Nature Biotechnology, vol. 28, No. 6, Jun. 2010, 595-599.

Samai, et al., "Co-Transcriptional DNA and RNA Cleavage During Type III CRISPR-Cas Immunity", Cell, vol. 161, No. 5, May 21, 2015, 1164-1174.

Shafiee, et al., "Paper and Flexible Substrates as Materials for Biosensing Platforms to Detect Multiple Biotargets", Scientific Reports, vol. 5, No. 8719, Mar. 6, 2015, 1-9.

Sharma, et al., "Antisense Oligonucleotides: Modifications and Clinical Trials", MedChemComm, vol. 5, 2014, 1454-1471.

Shmakov, et al., "Discovery and Functional Characterization of Diverse Class 2 CRISPR-Cas Systems", Molecular Cell, vol. 60, No. 3, Nov. 5, 2015, 385-397.

(56) References Cited

OTHER PUBLICATIONS

Smargon, et al., "Cas 13B is a Type VI-B CRISPR-Associated RNA-Guided RNAse Differentially Regulated by Accessory Proteins Csx27 and Csx28", Molecular Cell, vol. 65, No. 4, Feb. 16, 2017, 618-630.
Song, et al., "Direct Detection of Bacterial Genomic DNA at Sub-Femtomolar Concentrations Using Single Molecule Arrays", Analytical Chemistry, vol. 85, No. 3, 2013, 1932-1939.
St John, et al., "Existing and Emerging Technologies for Point-of-Care Testing", The Clinical Biochemist Reviews, vol. 35, No. 3, Aug. 2014, 155-167.
Urdea, et al., "Requirements for High Impact Diagnostics in the Developing World", Nature, vol. 444, 2006, 73-79.
Vashist, et al., "Commercial Smartphone-Based Devices and Smart Applications for Personalized Healthcare Monitoring and Management", Diagnostics, vol. 4, No. 3, Aug. 14, 2014, 104-128.
Wang, et al., "Flexible Substrate-Based Devices for Point-of-Care Diagnostics", Trends in Biotechnology, vol. 34, No. 11, Nov. 2016, 909-921.

\* cited by examiner

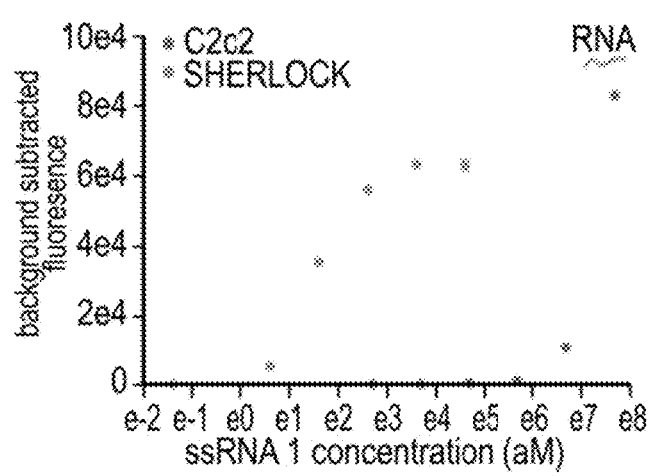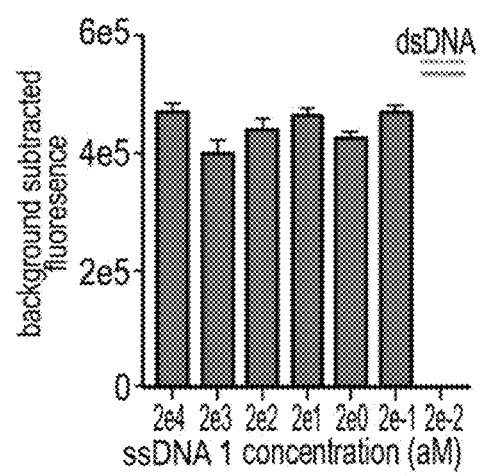
FIG. 27A  FIG. 27B

This is C2c2 signal on paper for a 20pM target. Note that the freeze-drying before actually boosts signal (the right plot).

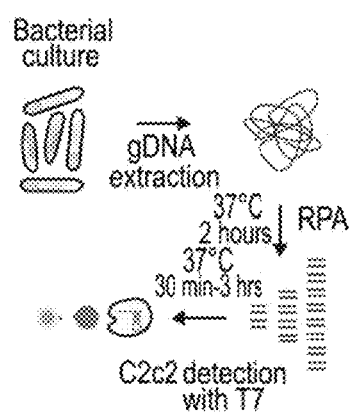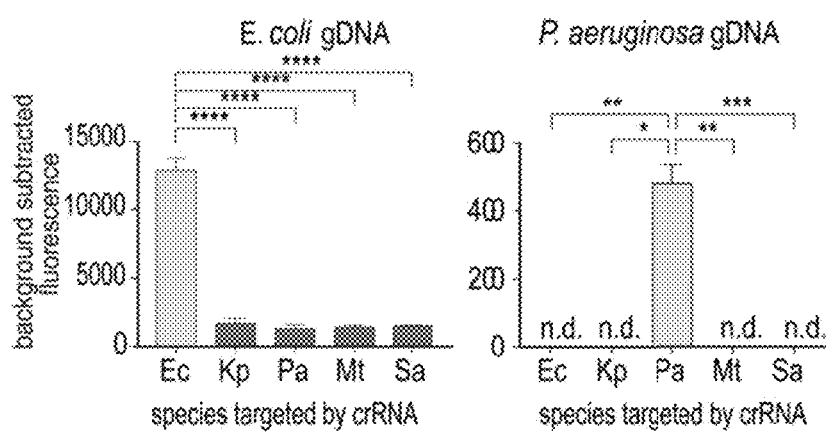
FIG. 34A  FIG. 34B  FIG. 34C

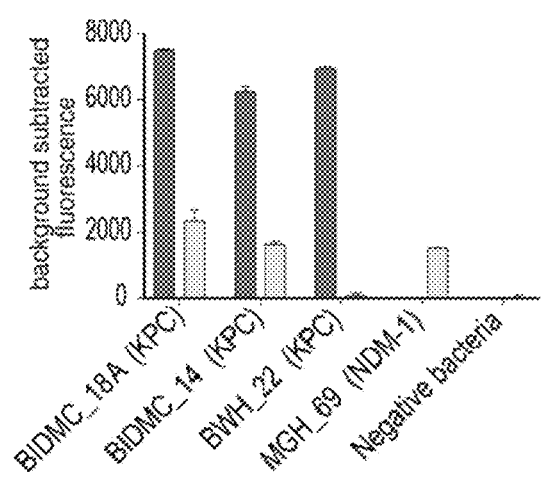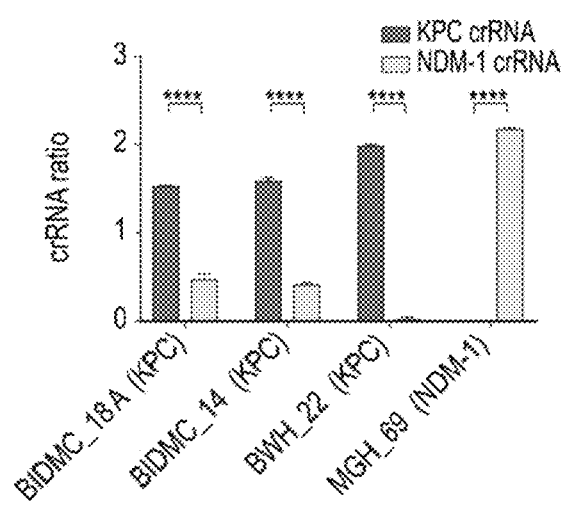
FIG. 35A  FIG. 35B

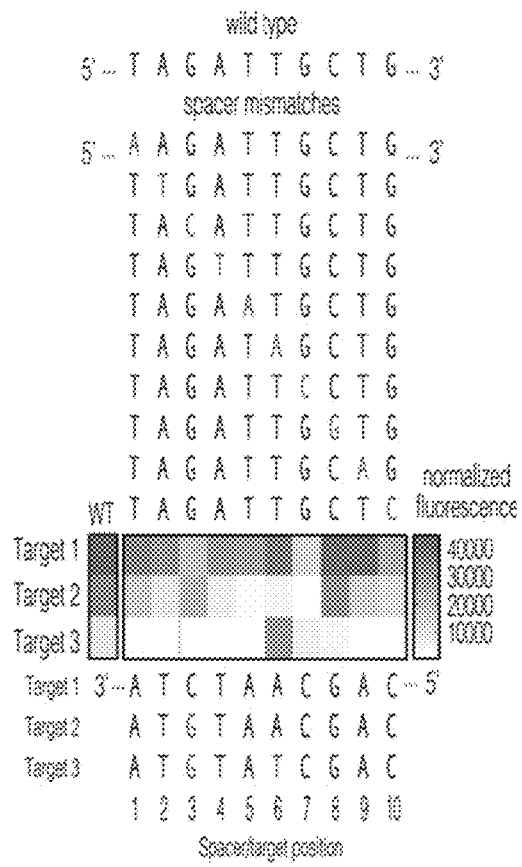
FIG. 36A
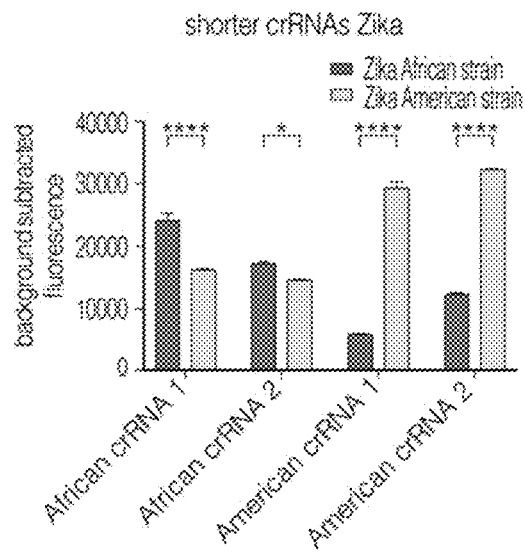
FIG. 36C
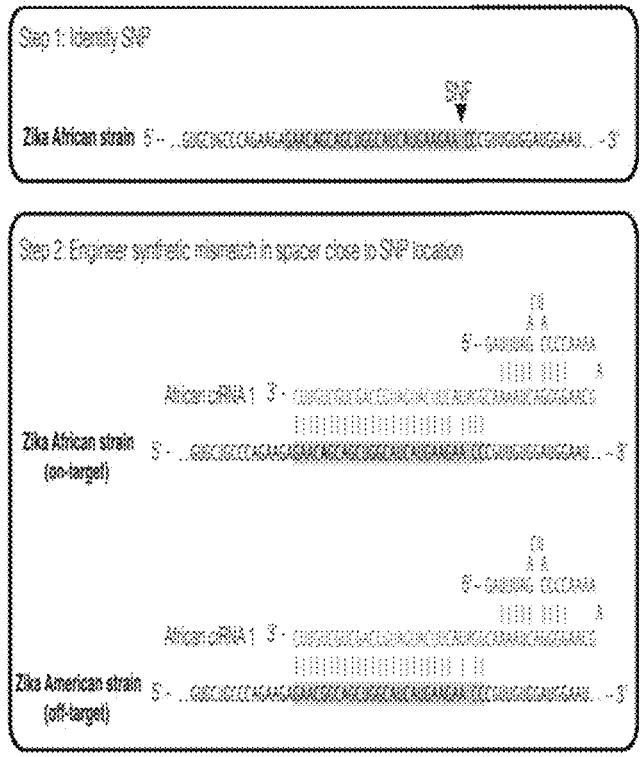
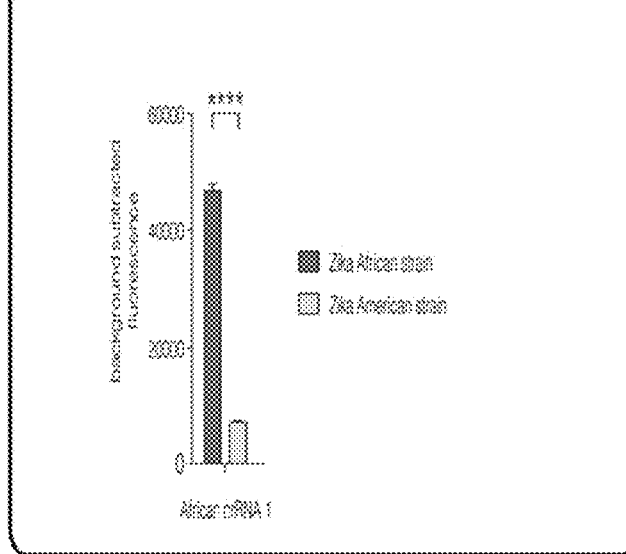
FIG. 36B

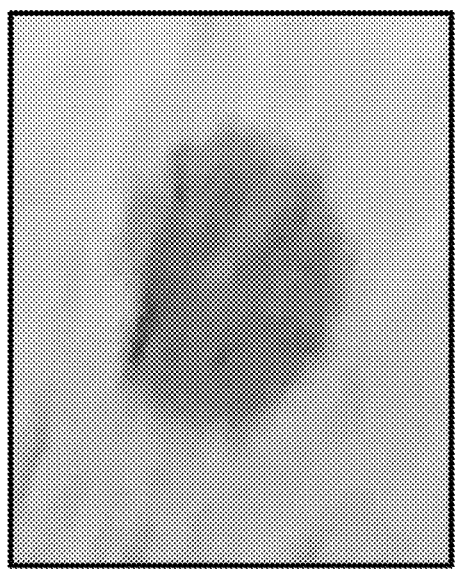
30 units RNase A      no RNase A
FIG. 47

|  |  | 586 603 | 1276 1298 |
|---|---|---|---|
| c2c2 | Leptotrichia shahii | IRKFTKIGTN ERNRILHA | SIRNYISHFYIVRNP |
| c2c2-5 | Lachnospiraceae bacterium MA2020 | LYSLKSHLYS MRNSSFHF | IFRNEIDHFNYFYDR |
| c2c2-6 | Lachnospiraceae | LTDLKDVIYS MRNDSFHY | ELRNYIEHFRYYSSF |
| c2c2-7 | [Clostridium] ammophilum DSM 10710 | ADDLRKAIYS LRNETFHF | DVRKYVDHFKYYATS |
| c2c2-8 | Carnobacterium gallinarum DSM 4847 | IWALRGSVQQ IRNEIFHS | KIRNQTAHLSVLQLE |
| c2c2-9 | Carnobacterium gallinarum DSM 4847 | LWAIRGAVQR VRNQIFHQ | EIRNNIAHLHVLRND |
| c2c2-10 | Paludibacter propionicigenes WB4 | LWGIRGAVQQ IRNNVNHY | DIRNHIAHFNYLTKD |
| c2c2-11 | Listeria weihenstephanensis FSL R9-0317 | IWAIRGSIQQ IRNEVYHC | NARNHIAHLNYLSLK |
| c2c2-12 | Listeriaceae bacterium FSL M6-0635 | IWAIRGSIQQ IRNEVYHC | NARNHIAHLNYLSLK |
| c2c2-13 | Leptotrichia wadei F0279 | FANIDEAISS IRHGIVHF | YIRNYIAHFNYIPHA |
| c2c2-14 | Rhodobacter capsulatus SB 1003 | VFALLRYLRG CRNQTFHL | QTRKDLAHFNVLDRA |
| c2c2-15 | Rhodobacter capsulatus R121 | VFALLRYLRG CRNQTFHL | QTRKDLAHFNVLDRA |
| c2c2-16 | Rhodobacter capsulatus DE442 | VFALLRYLRG CRNQTFHL | QTRKDLAHFNVLDRA |
| c2-3 | L wadei (Lw2) | FANIDEAISS IRHGIVHF | YIRNYIAHFNYIPHA |
| c2-4 | Listeria seeligeri | SWGLRGAIAP IRNEIIHL | EKRNNISHFRYLNGQ |
|  |  | ⇑⇑ ⇑ | ⇑⇑ ⇑ |

FIG. 50

```
         UC
        A A
   AAAACCCC GAUUUAG  -5'
 A  ||||  |||||
   GCAAGGGGACUAAAACUAGAUUGCUGUUCUACCAAGUAAUCCAU  -3' 28nt
                   UAGAUUGCUGUUCUACCAAGUAA       -3' 23nt
                   UAGAUUGCUGUUCUACCAAG          -3' 20nt
```

```
3'-..AUCUAACGACAAGAUGGUUCAUUAGGUA..  -5' ssRNA 1
3'-..AU■UAACGACAAGAUGGUUCAUUAGGUA..  -5' ssRNA 2

UAGAUUGCUGUUCUACC..    None
   AAGAUUGCUGUUCUACC..    1
   UUGAUUGCUGUUCUACC..    2       crRNA
   UAGUUUGCUGUUCUACC..    4       mismatch
   UAGAAUGCUGUUCUACC..    5       position
   UAGAUAGCUGUUCUACC..    6
   UAGAUUCCUGUUCUACC..    7
```

FIG. 57A

```
3' - ..CUCAUCUAACGACAAGAUGGUUCAUUAGGUA.. - 5' ssRNA 1
3' - ..CUCAU■UAACGACAAGAUGGUUCAUUAGGUA.. - 5' ssRNA 2

..AAGAUUGCUGUUCUACCAAGUAAUCCAU  1
                 ..UUGAUUGCUGUUCUACCAAGUAAUCCAU  2
  target         ..UAGUUGCUGUUCUACCAAGUAAUCCAU   4   crRNA
  mismatch       ..UAGAUUGCUGUUCUACCAAGUAAUCCAU  5   mismatch
  position       ..UAGAUAGCUGUUCUACCAAGUAAUCCAU  6   position
     3           ..UAGAUCCUGUUCUACCAAGUAAUCCAU   7

3' - ..CUCAUCUAACGACAAGAUGGUUCAUUAGGUA.. - 5' ssRNA 1
3' - ..CUCAU■UAACGACAAGAUGGUUCAUUAGGUA.. - 5' ssRNA 2

..CUAGAUUGCUGUUCUACCAAGUAAUCCA  1
                 ..GAAGAUUGCUGUUCUACCAAGUAAUCCA  2
  target         ..GUUGAUUGCUGUUCUACCAAGUAAUCCA  3   crRNA
  mismatch       ..GUAGUUGCUGUUCUACCAAGUAAUCCA   5   mismatch
  position       ..GUAGAUUGCUGUUCUACCAAGUAAUCCA  6   position
     4           ..GUAGAUAGCUGUUCUACCAAGUAAUCCA  7

3' - ..CUCAUCUAACGACAAGAUGGUUCAUUAGGUA.. - 5' ssRNA 1
3' - ..CUCAU■UAACGACAAGAUGGUUCAUUAGGUA.. - 5' ssRNA 2

..ACUAGAUUGCUGUUCUACCAAGUAAUCC  2
                 ..AGAAGAUUGCUGUUCUACCAAGUAAUCC  3
  target         ..AGUUGAUUGCUGUUCUACCAAGUAAUCC  4   crRNA
  mismatch       ..AGUAGUUGCUGUUCUACCAAGUAAUCC   6   mismatch
  position       ..AGUAGAAUGCUGUUCUACCAAGUAAUCC  7   position
     5           ..AGUAGAUAGCUGUUCUACCAAGUAAUCC  8

3' - ..CUCAUCUAACGACAAGAUGGUUCAUUAGGUA.. - 5' ssRNA 1
3' - ..CUCAU■UAACGACAAGAUGGUUCAUUAGGUA.. - 5' ssRNA 2

..GACUAGAUUGCUGUUCUACCAAGUAAUC  3
                 ..GACAAGAUUGCUGUUCUACCAAGUAAUC  4
  target         ..GAGUUGAUUGCUGUUCUACCAAGUAAUC  5   crRNA
  mismatch       ..GAGUAGUUGCUGUUCUACCAAGUAAUC   7   mismatch
  position       ..GAGUAGAAUGCUGUUCUACCAAGUAAUC  8   position
     6           ..GAGUAGAUAGCUGUUCUACCAAGUAAUC  9
```

FIG. 58A

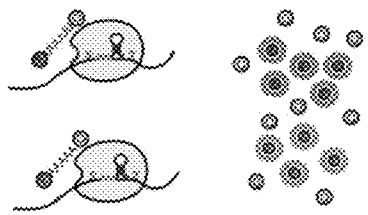
FIG. 81A
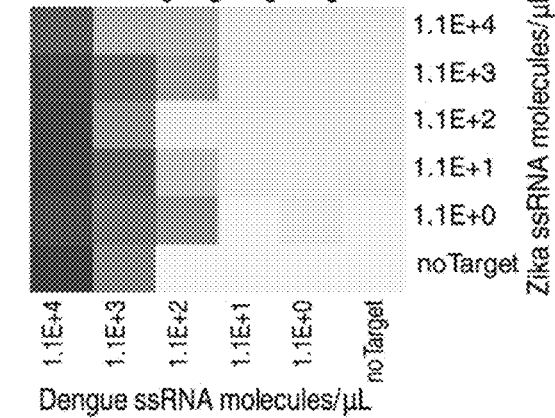
FIG. 81B
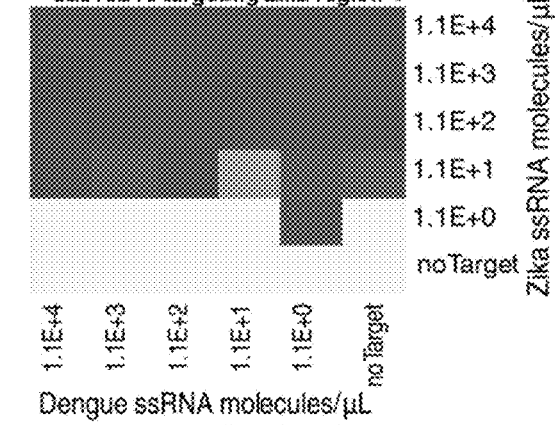
FIG. 81C
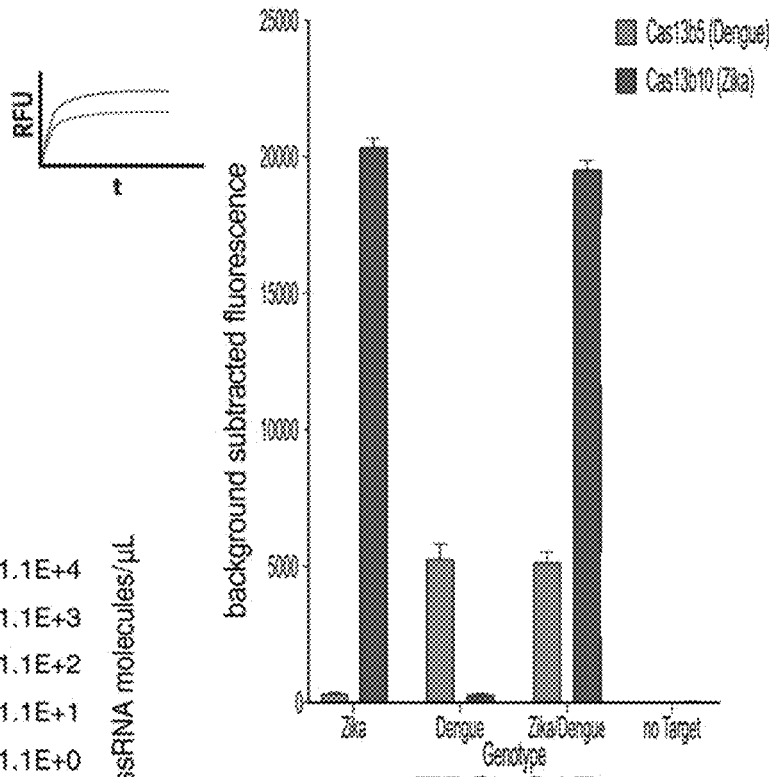
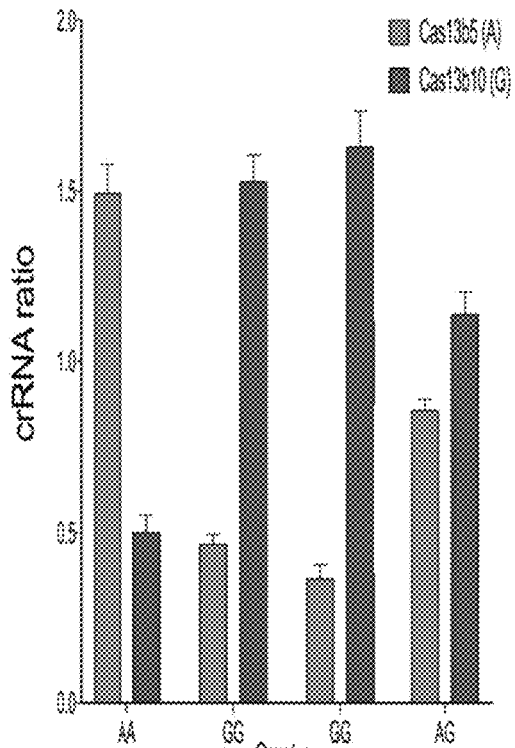
FIG. 81D

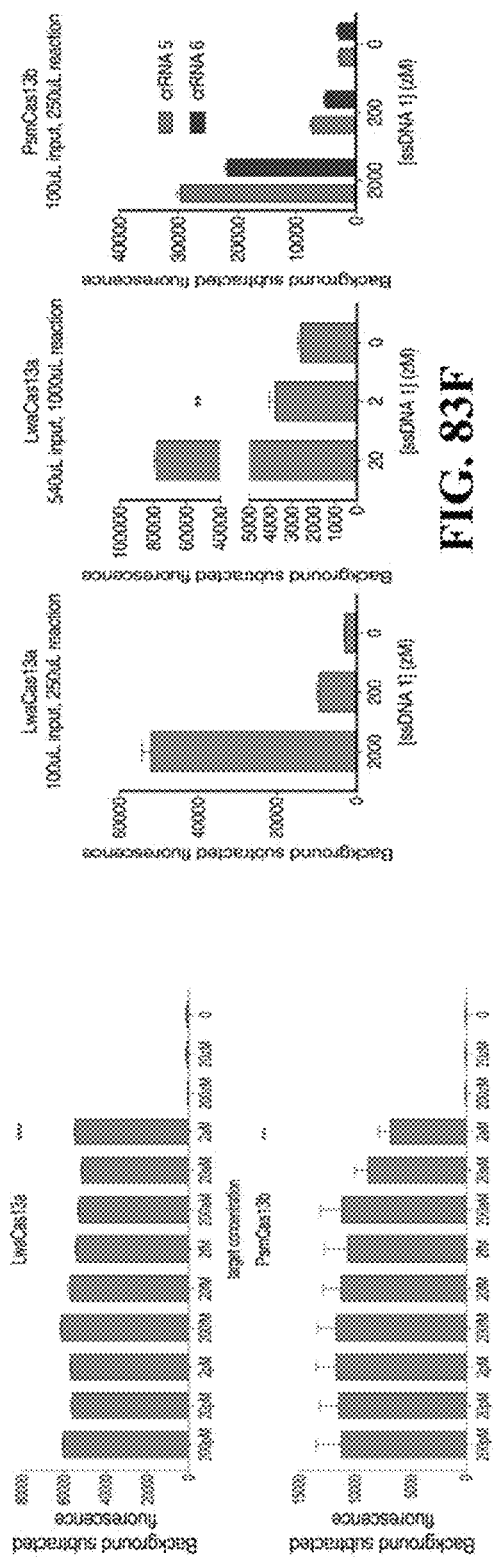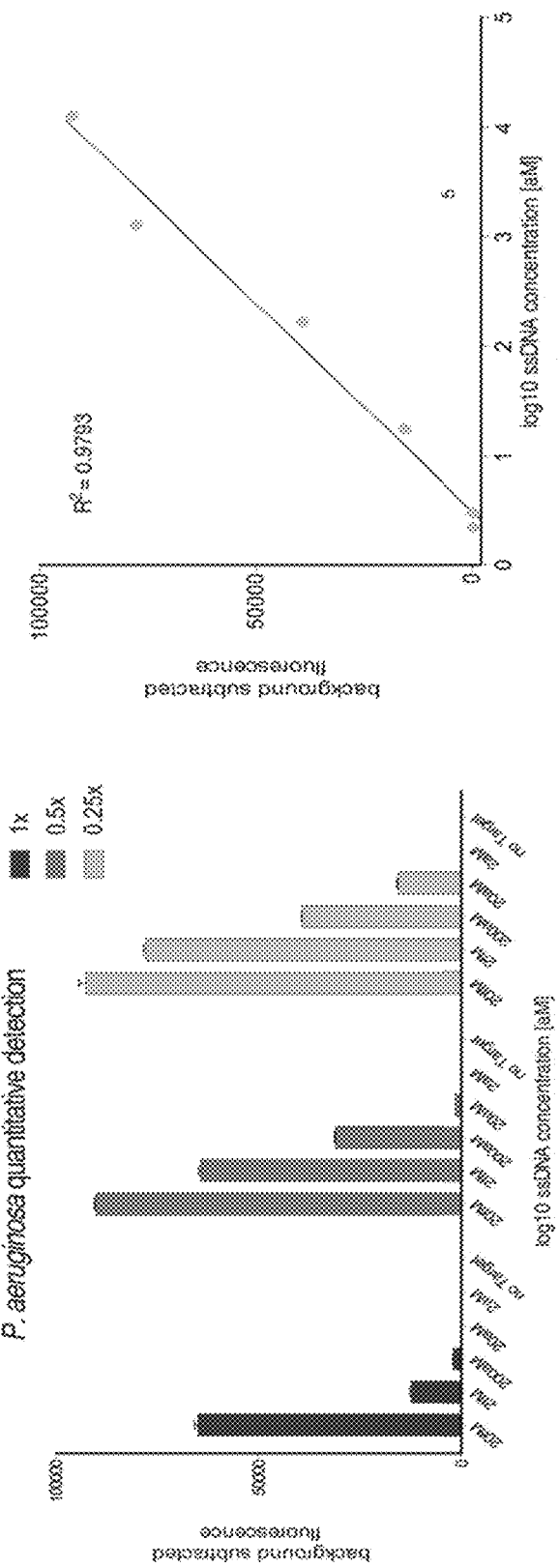

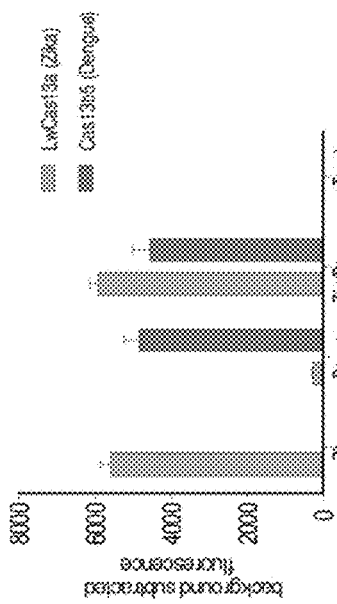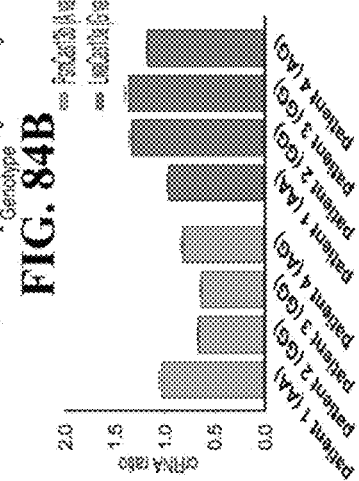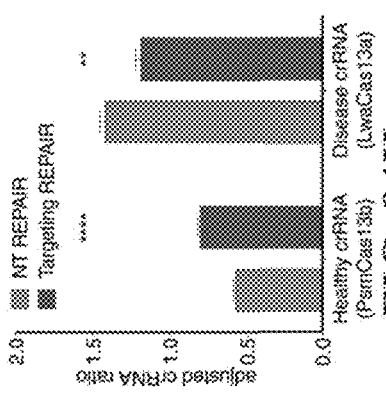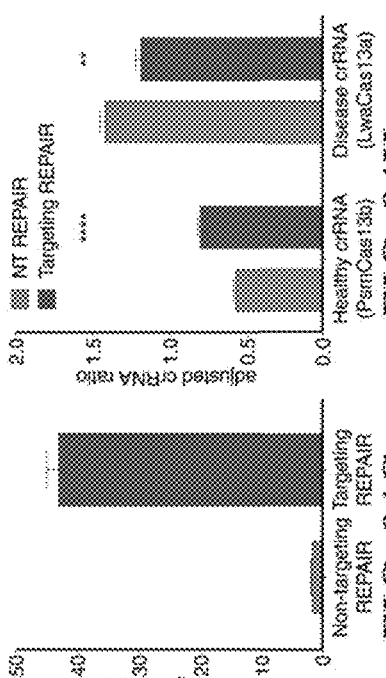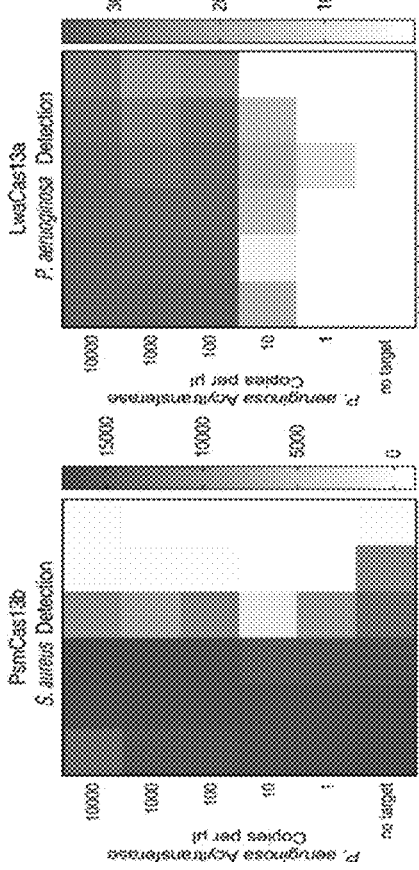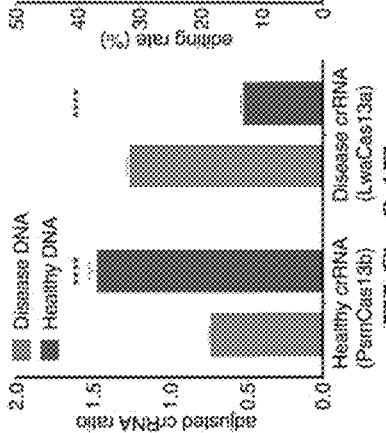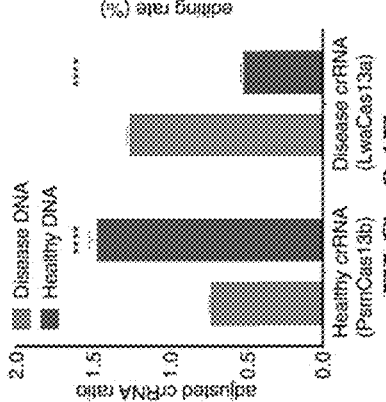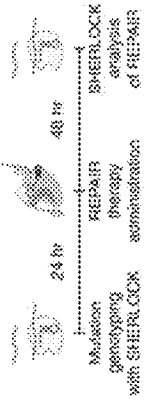

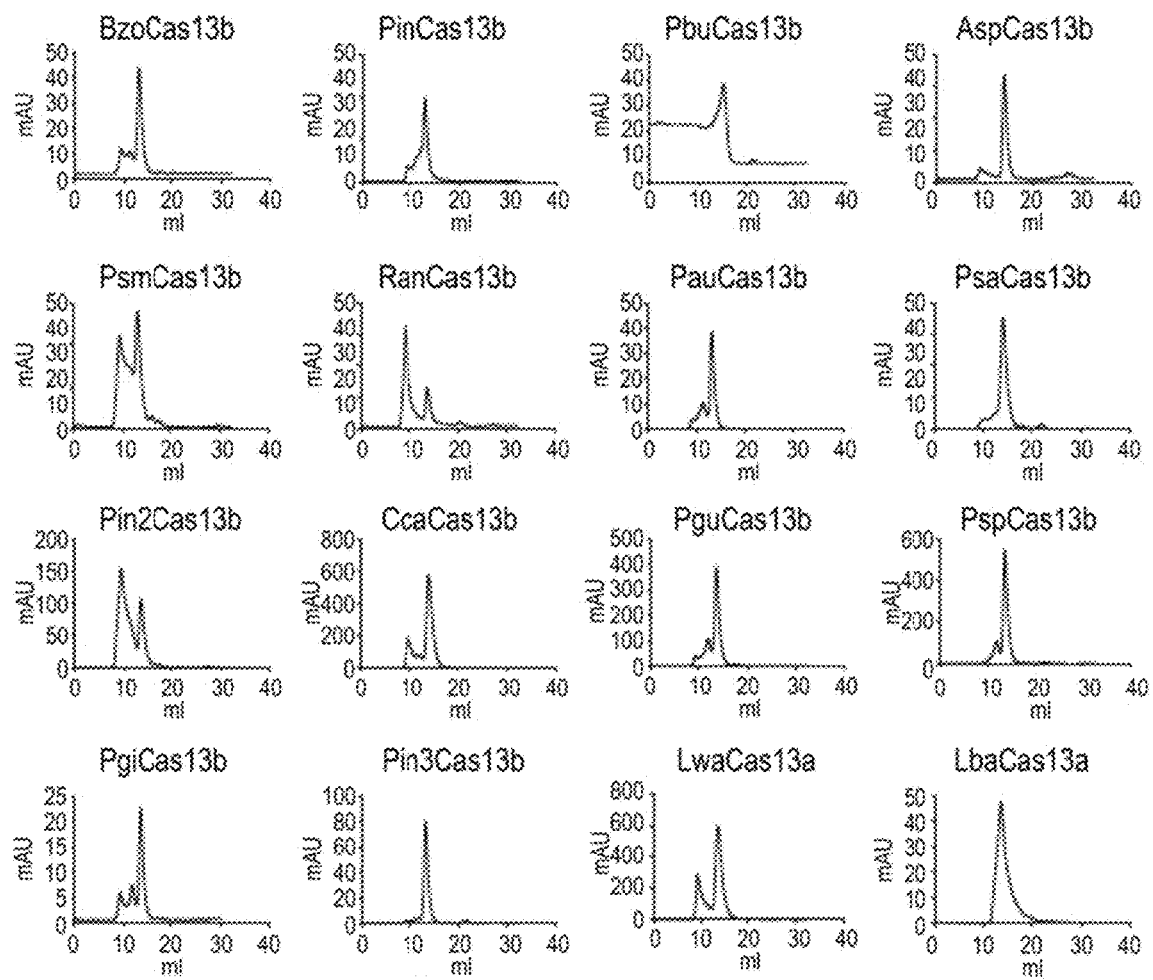
FIG. 86A
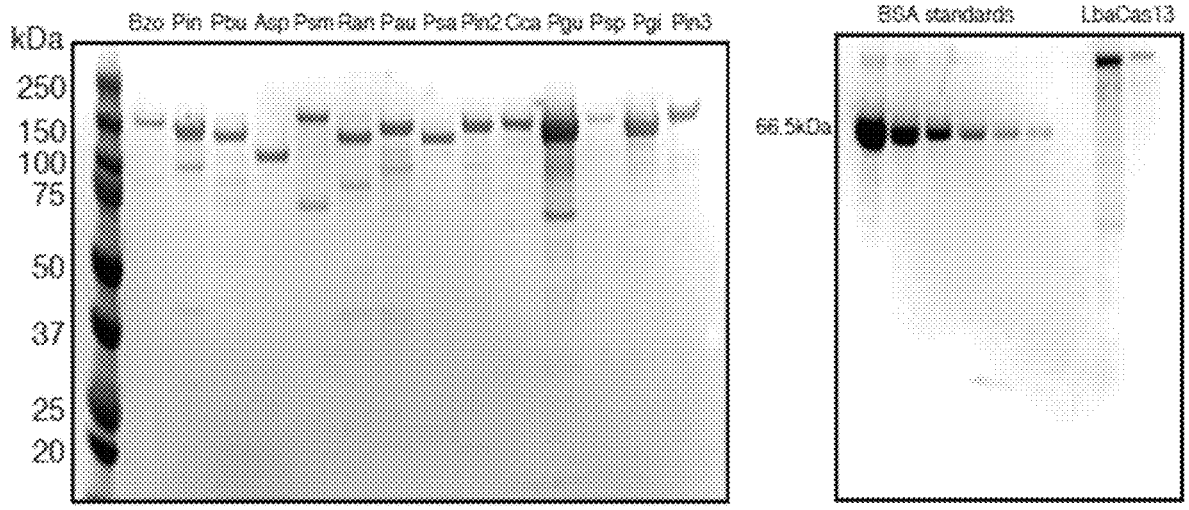
FIG. 86B  FIG. 86C

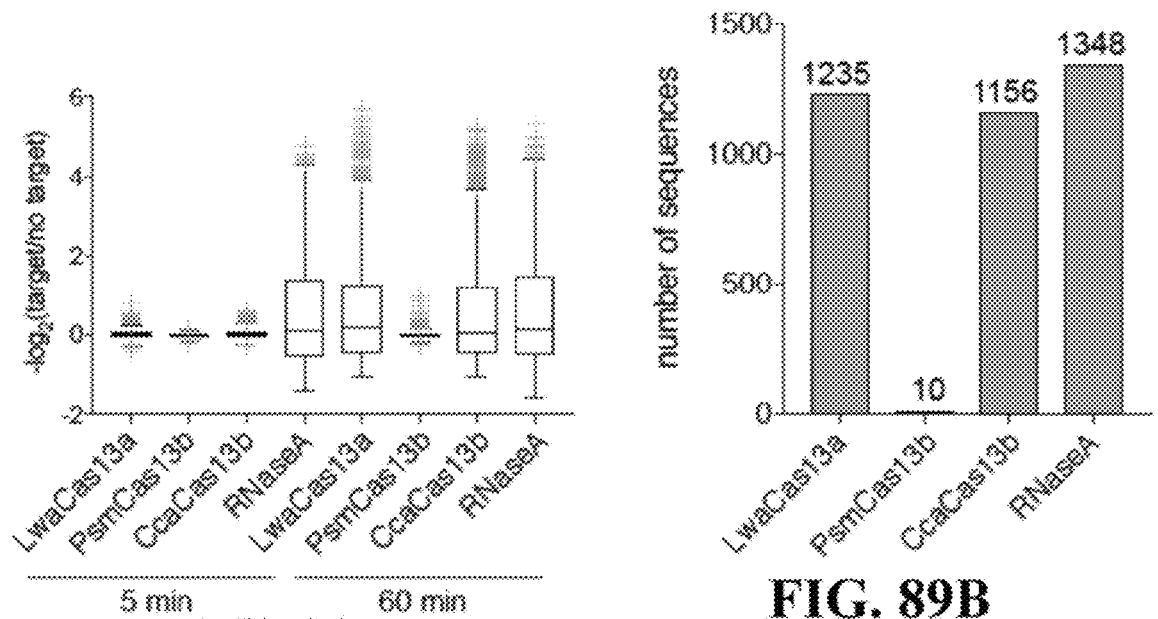
FIG. 89A
FIG. 89B
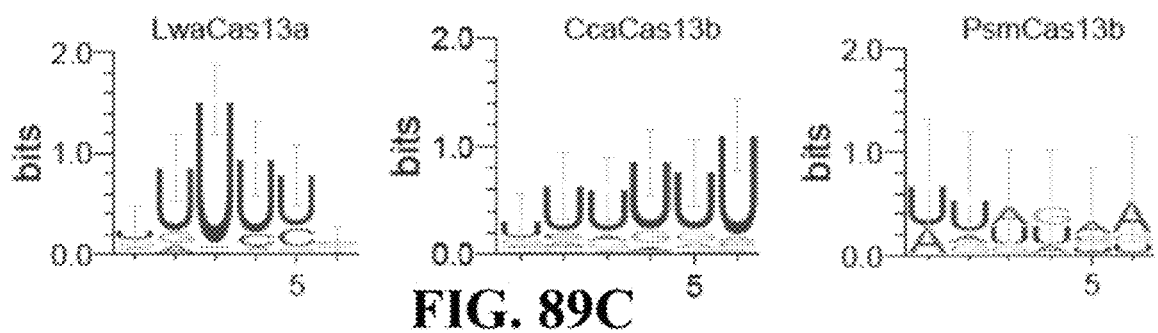
FIG. 89C
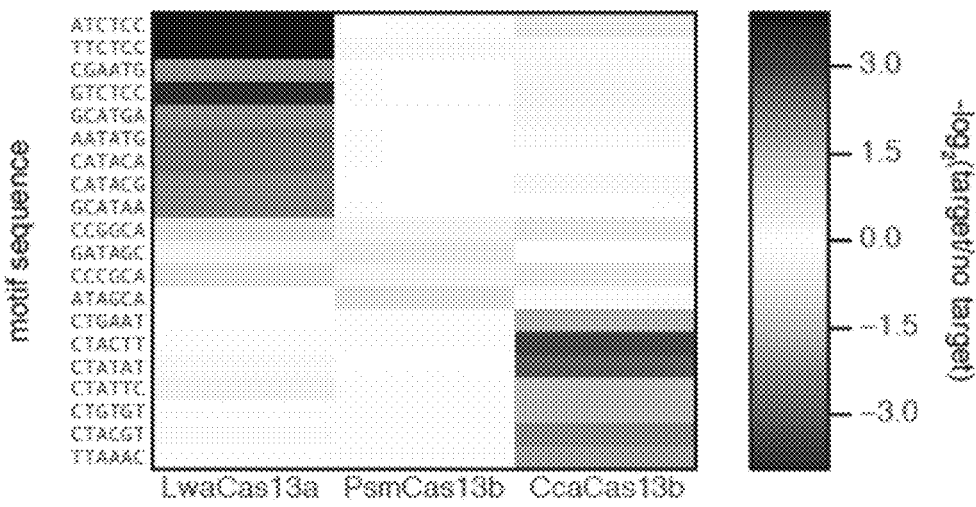
FIG. 89D

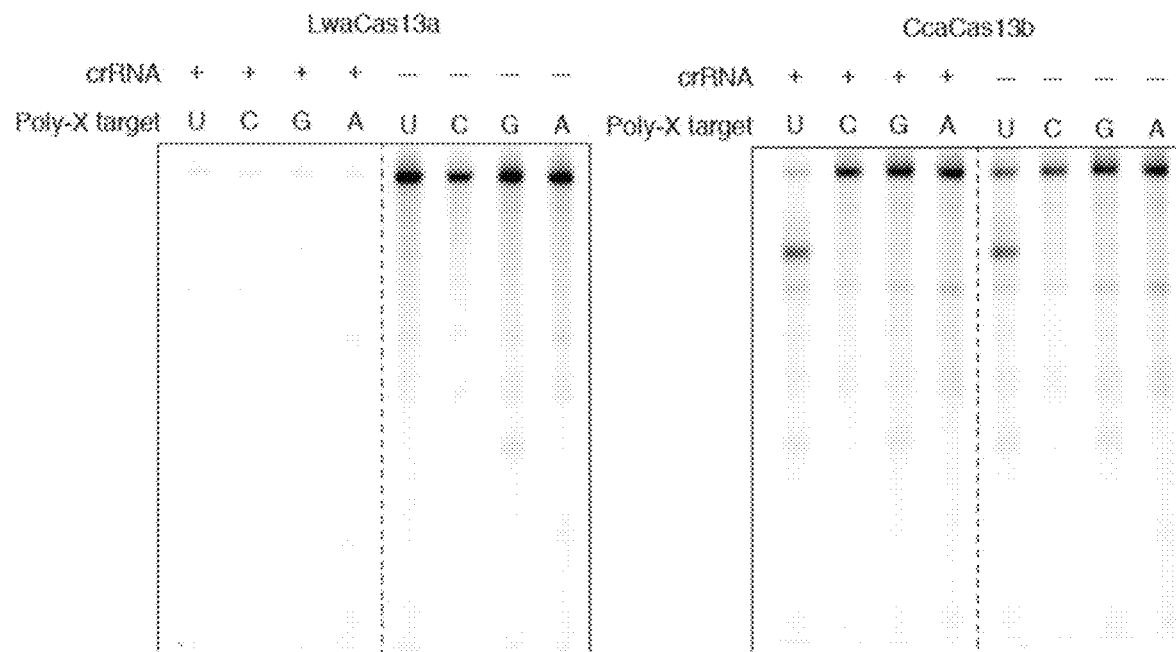
FIG. 93A  FIG. 93B
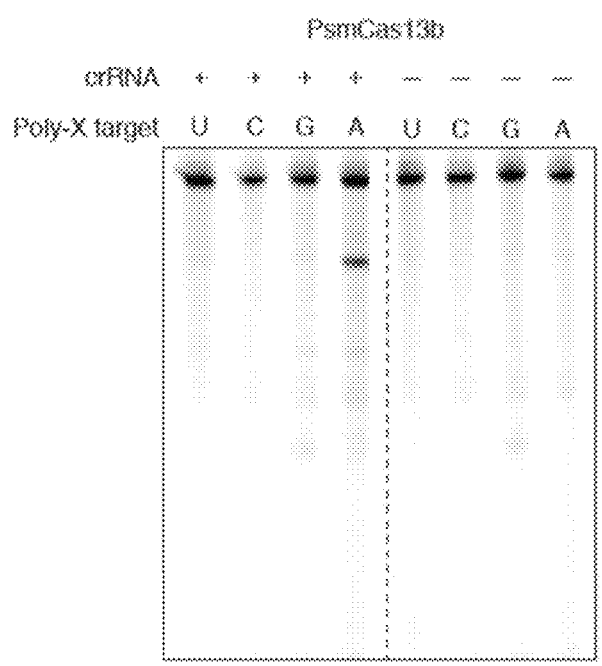
FIG. 93C

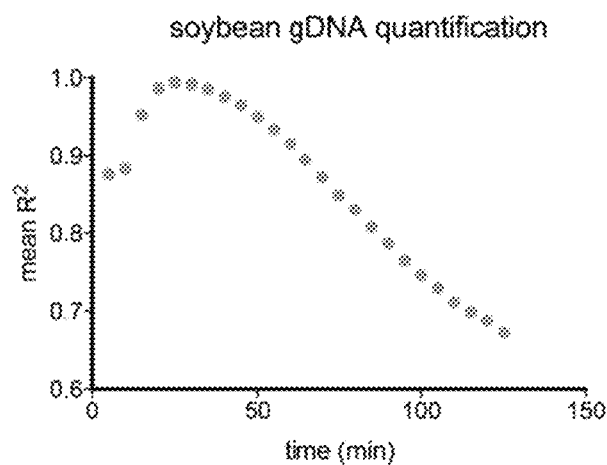
FIG. 106A
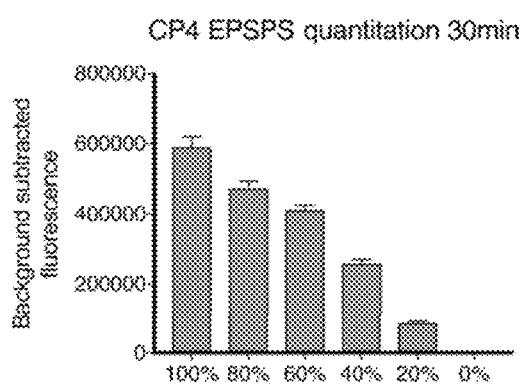 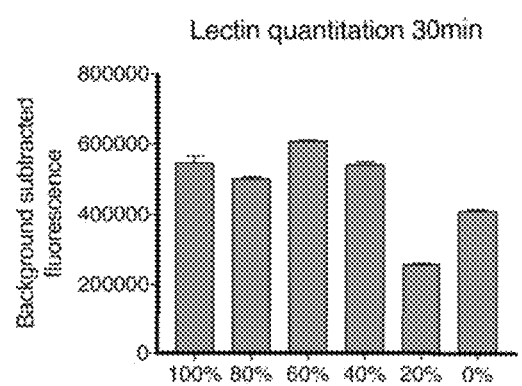
FIG. 106B  FIG. 106C

DEVICES FOR CRISPR EFFECTOR SYSTEM BASED DIAGNOSTICS

CROSS-REFERENCE TO RELATED APPLICATIONS

This application claims the benefit of U.S. Provisional Application No. 62/471,940 filed Mar. 15, 2017; U.S. Provisional Application No. 62/484,859 filed Apr. 12, 2017; and U.S. Provisional Application No. 62/568,268 filed Oct. 4, 2017. The entire contents of the above-identified applications are hereby fully incorporated herein by reference.

STATEMENT REGARDING FEDERALLY SPONSORED RESEARCH

This invention was made with government support under grant numbers MH100706 and MH110049 awarded by the National Institutes of Health, and grant number HDTRA1-14-1-0006 granted by the Defense Threat Reduction Agency. The government has certain rights in the invention.

REFERENCE TO AN ELECTRONIC SEQUENCE LISTING

The contents of the electronic sequence listing ("BROD-2042_ST25.txt; size is 2,713,716 bytes and it was created on Mar. 15, 2018) is herein incorporated by reference in its entirety.

TECHNICAL FIELD

The subject matter disclosed herein is generally directed to rapid diagnostics related to the use of CRISPR effector systems.

BACKGROUND

Nucleic acids are a universal signature of biological information. The ability to rapidly detect nucleic acids with high sensitivity and single-base specificity on a portable platform has the potential to revolutionize diagnosis and monitoring for many diseases, provide valuable epidemiological information, and serve as a generalizable scientific tool. Although many methods have been developed for detecting nucleic acids (Du et al., 2017; Green et al., 2014; Kumar et al., 2014; Pardee et al., 2014; Pardee et al., 2016; Urdea et al., 2006), they inevitably suffer from trade-offs among sensitivity, specificity, simplicity, and speed. For example, qPCR approaches are sensitive but are expensive and rely on complex instrumentation, limiting usability to highly trained operators in laboratory settings. Other approaches, such as new methods combining isothermal nucleic acid amplification with portable platforms (Du et al., 2017; Pardee et al., 2016), offer high detection specificity in a point-of-care (POC) setting, but have somewhat limited applications due to low sensitivity. As nucleic acid diagnostics become increasingly relevant for a variety of healthcare applications, detection technologies that provide high specificity and sensitivity at low cost would be of great utility in both clinical and basic research settings.

SUMMARY

In one aspect, the invention provides a nucleic acid detection system comprising: a CRISPR system comprising an effector protein and one or more guide RNAs designed to bind to corresponding target molecules; an RNA-based masking construct; and optionally, nucleic acid amplification reagents to amplify target RNA molecules in a sample. In another aspect, the embodiments provide a polypeptide detection system comprising: a CRISPR system comprising an effector protein and one or more guide RNAs designed to bind a trigger RNA, an RNA-based masking construct; and one or more detection aptamers comprising a masked RNA polymerase promoter binding site or a masked primer binding site.

In further embodiments, the system may further comprise nucleic acid amplification reagents. The nucleic acid amplification reagents may comprise a primer comprising an RNA polymerase promoter. In certain embodiments, sample nucleic acids are amplified to obtain a DNA template comprising an RNA polymerase promoter, whereby a target RNA molecule may be generated by transcription. The nucleic acid may be DNA and amplified by any method described herein. The nucleic acid may be RNA and amplified by a reverse transcription method as described herein. The aptamer sequence may be amplified upon unmasking of the primer binding site, whereby a trigger RNA is transcribed from the amplified DNA product. The target molecule may be a target DNA and the system may further comprise a primer that binds the target DNA and comprises an RNA polymerase promoter.

In one example embodiment, the CRISPR system effector protein is an RNA-targeting effector protein. Example RNA-targeting effector proteins include Cas13b and C2c2 (now known as Cas13a). It will be understood that the term "C2c2" herein is used interchangeably with "Cas13a". In another example embodiment, the RNA-targeting effector protein is C2c2. In other embodiments, the C2c2 effector protein is from an organism of a genus selected from the group consisting of: *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma, Campylobacter,* and *Lachnospira*, or the C2c2 effector protein is an organism selected from the group consisting of: *Leptotrichia shahii, Leptotrichia wadei, Listeria seeligeri, Clostridium aminophilum, Carnobacterium gallinarum, Paludibacter propionicigenes, Listeria weihenstephanensis*, or the C2c2 effector protein is a *L. wadei* F0279 or *L. wadei* F0279 (Lw2) C2C2 effector protein. In another embodiment, the one or more guide RNAs are designed to detect a single nucleotide polymorphism, splice variant of a transcript, or a frameshift mutation in a target RNA or DNA.

In other embodiments, the one or more guide RNAs are designed to bind to one or more target molecules that are diagnostic for a disease state. In still further embodiments, the disease state is an infection, an organ disease, a blood disease, an immune system disease, a cancer, a brain and nervous system disease, an endocrine disease, a pregnancy or childbirth-related disease, an inherited disease, or an environmentally-acquired disease. In still further embodiments, the disease state is cancer or an autoimmune disease or an infection.

In further embodiments, the one or more guide RNAs are designed to bind to one or more target molecules comprising cancer specific somatic mutations. The cancer specific mutation may confer drug resistance. The drug resistance mutation may be induced by treatment with ibrutinib, erlotinib, imatinib, gefitinib, crizotinib, trastuzumab, vemurafenib, RAF/MEK, check point blockade therapy, or antiestrogen therapy. The cancer specific mutations may be present in one or more genes encoding a protein selected from the group consisting of Programmed Death-Ligand 1 (PD-L1), androgen receptor (AR), Bruton's Tyrosine Kinase (BTK), Epidermal Growth Factor Receptor (EGFR), BCR-Ab1, c-kit, PIK3CA, HER2, EML4-ALK, KRAS, ALK, ROS1, AKT1, BRAF, MEK1, MEK2, NRAS, RAC1, and ESR1. The cancer specific mutation may be a mutation in a gene selected from the group consisting of CASP8, B2M, PIK3CA, SMC1A, AR1D5B, TET2, ALPK2, COL5A1, TP53, DNER, NCOR1, MORC4, CIC, IRF6, MYOCD, ANKLE1, CNKSR1, NF1, SOS1, ARID2, CUL4B, DDX3X, FUBP1, TCP11L2, HLA-A, B or C, CSNK2A1, MET, ASXL1, PD-L1, PD-L2, IDOL IDO2, ALOX12B and ALOX15B, or copy number gain, excluding whole-chromosome events, impacting any of the following chromosomal bands: 6q16.1-q21, 6q22.31-q24.1, 6q25.1-q26, 7p11.2-q11.1, 8p23.1, 8p11.23-p11.21 (containing IDO1, IDO2), 9p24.2-p23 (containing PDL1, PDL2), 10p15.3, 10p15.1-p13, 11p14.1, 12p13.32-p13.2, 17p13.1 (containing ALOX12B, ALOX15B), and 22q11.1-q11.21.

In further embodiments, the one or more guide RNAs may be designed to bind to one or more target molecules comprising loss-of-heterozygosity (LOH) markers.

In further embodiments, the one or more guide RNAs may be designed to bind to one or more target molecules comprising single nucleotide polymorphisms (SNP). The disease may be heart disease and the target molecules may be VKORC1, CYP2C9, and CYP2C19.

In further embodiments, the disease state may be a pregnancy or childbirth-related disease or an inherited disease. The sample may be a blood sample or mucous sample. The disease may be selected from the group consisting of Trisomy 13, Trisomy 16, Trisomy 18, Klinefelter syndrome (47, XXY), (47, XYY) and (47, XXX), Turner syndrome, Down syndrome (Trisomy 21), Cystic Fibrosis, Huntington's Disease, Beta Thalassaemia, Myotonic Dystrophy, Sickle Cell Anemia, *Porphyria*, Fragile-X-Syndrome, Robertsonian translocation, Angelman syndrome, DiGeorge syndrome and Wolf-Hirschhorn Syndrome.

In further embodiments, the infection is caused by a virus, a bacterium, or a fungus, or the infection is a viral infection. In specific embodiments, the viral infection is caused by a double-stranded RNA virus, a positive sense RNA virus, a negative sense RNA virus, a retrovirus, or a combination thereof, or the viral infection is caused by a Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus, or the viral infection is caused by Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

In other embodiments of the invention, the RNA-based masking construct suppresses generation of a detectable positive signal or the RNA-based masking construct suppresses generation of a detectable positive signal by masking the detectable positive signal, or generating a detectable negative signal instead, or the RNA-based masking construct comprises a silencing RNA that suppresses generation of a gene product encoded by a reporting construct, wherein the gene product generates the detectable positive signal when expressed.

In further embodiments, the RNA-based masking construct is a ribozyme that generates the negative detectable signal, and wherein the positive detectable signal is generated when the ribozyme is deactivated, or the ribozyme converts a substrate to a first color and wherein the substrate converts to a second color when the ribozyme is deactivated.

In other embodiments, the RNA-based masking agent is an RNA aptamer, or the aptamer sequesters an enzyme, wherein the enzyme generates a detectable signal upon release from the aptamer by acting upon a substrate, or the aptamer sequesters a pair of agents that when released from the aptamers combine to generate a detectable signal.

In another embodiment, the RNA-based masking construct comprises an RNA oligonucleotide to which a detectable ligand and a masking component are attached. In another embodiment, the detectable ligand is a fluorophore and the masking component is a quencher molecule, or the reagents to amplify target RNA molecules such as, but not limited to, NASBA or RPA reagents.

In another aspect, the invention provides a diagnostic device comprising one or more individual discrete volumes, each individual discrete volume comprising a CRISPR effector protein, one or more guide RNAs designed to bind to corresponding target molecule, an RNA-based masking construct, and optionally further comprise nucleic acid amplification reagents.

In another aspect, the invention provides a diagnostic device comprising one or more individual discrete volumes, each individual discrete volume comprising a CRISPR effector protein, one or more guide RNAs designed to bind to a trigger RNA, one or more detection aptamers comprising a masked RNA polymerase promoter binding site or a masked primer binding site, and optionally further comprising nucleic acid amplification reagents.

In some embodiments, the individual discrete volumes are droplets, or the individual discrete volumes are defined on a solid substrate, or the individual discrete volumes are microwells, or the individual discrete volumes are spots defined on a substrate, such as a paper substrate.

In one embodiment, the RNA targeting effector protein is a CRISPR Type VI RNA-targeting effector protein such as C2c2 or Cas13b. In certain example embodiments, the C2c2 effector protein is from an organism selected from the group consisting of: Leptotrichia, *Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*, or the C2c2 effector protein is selected from the group consisting of: *Leptotrichia shahii, L. wadei, Listeria seeligeri, Lachnospiraceae bacterium, Clostridium aminophilum, Carnobacterium gallinarum, Paludibacter propionicigenes, Listeria weihenstephanensis*, Listeriaceae bacterium, and *Rhodobacter capsulatus*, the C2c2 effector protein is a *L. wadei* F0279 or *L. wadei* F0279 (Lw2) C2c2 effector protein. In another embodiment, the one or more guide RNAs are designed to bind to one or more target RNA sequences that are diagnostic for a disease state.

In certain example embodiments, the RNA-based masking construct suppresses generation of a detectable positive signal, or the RNA-based masking construct suppresses generation of a detectable positive signal by masking the detectable positive signal, or generating a detectable negative signal instead, or the RNA-based masking construct comprises a silencing RNA that suppresses generation of a gene product encoded by a reporting construct, wherein the gene product generates the detectable positive signal when expressed.

In another example embodiment, the RNA-based masking construct is a ribozyme that generates a negative detectable signal, and wherein the positive detectable signal is generated when the ribozyme is deactivated. In one example embodiment, the ribozyme converts a substrate to a first color and wherein the substrate converts to a second color when the ribozyme is deactivated. In another example embodiment, the RNA-based masking agent is an aptamer that sequesters an enzyme, wherein the enzyme generates a detectable signal upon release from the aptamer by acting upon a substrate, or the aptamer sequesters a pair of agents that when released from the aptamers combine to generate a detectable signal.

In another example embodiment, the RNA-based masking construct comprises an RNA oligonucleotide to which are attached a detectable ligand oligonucleotide and a masking component. In certain example embodiments, the detectable ligand is a fluorophore and the masking component is a quencher molecule.

In another aspect, the invention provides a method for detecting target RNAs in samples, comprising: distributing a sample or set of samples into one or more individual discrete volumes, the individual discrete volumes comprising a CRISPR system comprising an effector protein, one or more guide RNAs, an RNA-based masking construct; incubating the sample or set of samples under conditions sufficient to allow binding of the one or more guide RNAs to one or more target molecules; activating the CRISPR effector protein via binding of the one or more guide RNAs to the one or more target molecules, wherein activating the CRISPR effector protein results in modification of the RNA-based masking construct such that a detectable positive signal is produced; and detecting the detectable positive signal, wherein detection of the detectable positive signal indicates a presence of one or more target molecules in the sample.

In another aspect, the invention provides a method for detecting peptides in samples, comprising: distributing a sample or set of samples into a set of individual discrete volumes, the individual discrete volumes comprising peptide detection aptamers, a CRISPR system comprising an effector protein, one or more guide RNAs, an RNA-based masking construct, wherein the peptide detection aptamers comprising a masked RNA polymerase site and configured to bind one or more target molecules; incubating the sample or set of samples under conditions sufficient to allow binding of the peptide detection aptamers to the one or more target molecules, wherein binding of the aptamer to a corresponding target molecule exposes the RNA polymerase binding site resulting in RNA synthesis of a trigger RNA; activating the CRISPR effector protein via binding of the one or more guide RNAs to the trigger RNA, wherein activating the CRISPR effector protein results in modification of the RNA-based masking construct such that a detectable positive signal is produced; and detecting the detectable positive signal, wherein detection of the detectable positive signal indicates a presence of one or more target molecules in a sample.

In certain example embodiments, such methods further comprise amplifying the sample RNA or the trigger RNA. In other embodiments, amplifying RNA comprises amplification by NASBA or RPA.

In certain example embodiments, the CRISPR effector protein is a CRISPR Type VI RNA-targeting effector protein, such as C2c2 or Cas13b. In other example embodiments, the C2c2 effector protein is from an organism selected from the group consisting of: *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*, or the C2c2 effector protein is selected from the group consisting of: *Leptotrichia shahii, L. wadei, Listeria seeligeri, Lachnospiraceae bacterium, Clostridium aminophilum, Carnobacterium gallinarum, Paludibacter propionicigenes, Listeria weihenstephanensis*, Listeriaceae bacterium, and *Rhodobacter capsulatus*. In a specific embodiment, the C2c2 effector protein is a *L. wadei* F0279 or *L. wadei* F0279 (Lw2) C2C2 effector protein.

In certain example embodiments, the one or more guide RNAs are designed to bind to one or more target molecules that are diagnostic for a disease state. In certain other example embodiments, the disease state is an infection, an organ disease, a blood disease, an immune system disease, a cancer, a brain and nervous system disease, an endocrine disease, a pregnancy or childbirth-related disease, an inherited disease, or an environmentally-acquired disease, cancer, or a fungal infection, a bacterial infection, a parasite infection, or a viral infection.

In certain example embodiments, the RNA-based masking construct suppresses generation of a detectable positive signal, or the RNA-based masking construct suppresses generation of a detectable positive signal by masking the detectable positive signal, or generating a detectable negative signal instead, or the RNA-based masking construct comprises a silencing RNA that suppresses generation of a gene product encoded by a reporting construct, wherein the gene product generates the detectable positive signal when expressed, or the RNA-based masking construct is a ribozyme that generates the negative detectable signal, and wherein the positive detectable signal is generated when the ribozyme is inactivated. In other example embodiments, the ribozyme converts a substrate to a first state and wherein the substrate converts to a second state when the ribozyme is inactivated, or the RNA-based masking agent is an aptamer, or the aptamer sequesters an enzyme, wherein the enzyme generates a detectable signal upon release from the aptamer by acting upon a substrate, or the aptamer sequesters a pair of agents that when released from the aptamers combine to generate a detectable signal. In still further embodiments, the RNA-based masking construct comprises an RNA oligonucleotide with a detectable ligand on a first end of the RNA oligonucleotide and a masking component on a second end of the RNA oligonucleotide, or the detectable ligand is a fluorophore and the masking component is a quencher molecule.

These and other aspects, objects, features, and advantages of the example embodiments will become apparent to those having ordinary skill in the art upon consideration of the following detailed description of illustrated example embodiments.

BRIEF DESCRIPTION OF THE DRAWINGS

FIG. 27A, 27B—provides a set of graphs demonstrating that (FIG. 27A) C2c2 detection of RNA without amplification can detect ssRNA target at concentrations down to 50 fM. (n=2 technical replicates; bars represent mean±s.e.m.), and that (FIG. 27B) the RPA-C2c2 reaction is capable of single-molecule DNA detection (n=4 technical replicates; bars represent mean±s.e.m.).

FIG. 31B—RT-RAP-C2c2 detection is capable of highly sensitive detection of the Zika lentiviral particles (n=4 technical replicates, two-tailed Student t-test; ***, p<0.0001; bars represent mean±s.e.m.) FIG. 31C shows a schematic of Zika RNA detection using freeze-dried C2c2 on paper, in accordance with certain example embodiments. FIG. 31D shows that a paper-based assay is capable of highly sensitive detection of Zika lentiviral particles (n-4 technical replicates, two-tailed Student t-test; , p<0.0001; , p<0.01, bars represent mean±s.e.m.).

FIG. 33F shows a quantitative curve for human zika cDNA detection showing significant correlation between input concentration and detected fluorescence. FIG. 33G is a graph illustrating C2c2 detection of ssRNA 1 performed in the presence of varying amounts of human serum (n=2 technical replicates, unless otherwise noted; bars represent mean±s.e.m.).

FIG. 34A provides a schematic of C2c2 detection of 16S rRNA gene from bacterial genomes using a universal V3 RPA primer set. FIGS. 34B and 34C are graphs illustrating the ability to achieve sensitive and specific detection of (FIG. 34B) *E. coli* or (FIG. 34C) *P. aeruginosa* gDNA using an assay conducted in accordance with certain example embodiments (n=4 technical replicates, two-tailed Student t-test; ****, p<0.0001; bars represent mean±s.e.m.). Ec, *Escherichia coli*; Kp, *Klebsiella pneumoniae*; Pa, *Pseudomonas aeruginosa*; Mt, *Mycobacterium tuberculosis*; Sa, *Staphylococcus aureus*.

FIG. 35A is a graph demonstrating detection of two different carbapenem-resistance genes (KPC and NDM-1) from four different clinical isolates of *Klebsiella pneumoniae*. FIG. 35B is a graph demonstrating detection of carbapenem-resistance genes (part A) is normalized as a ratio of signal between the KPC and NDM-1 crRNA assays (n=2 technical replicates, two-tailed Student t-test; ****, p<0.0001; bars represent mean±s.e.m.).

FIG. 36A illustrates that C2c2 is not sensitive to single mismatches, but can distinguish between single nucleotide differences in target when loaded with crRNAs with additional mismatches. ssRNA targets 1-3 were detected with 11 crRNAs, with 10 spacers containing synthetic mismatches at various positions in the crRNA. Mismatched spacers did not show reduced cleavage of target 1, but showed inhibited cleavage of mismatch targets 2 and 3 (SEQ. I.D. Nos. 146 through 159). FIG. 36B is a schematic showing the process for rational design of single-base specific spacers with synthetic mismatches. Synthetic mismatches are placed in proximity to the SNP or base of interest (SEQ. I.D. Nos. 160 through 164). FIG. 36C is a graph showing that specific detection of strain SNPs allows for the differentiation of Zika African versus American RNA targets differing by only one nucleotide using C2c2 detection with truncated (23 nucleotide) crRNAs (n=2 technical replicates, one-tailed Student t-test; *, p<0.05; ****, p<0.0001; bars represent mean±s.e.m.).

FIG. 47 is a set of pictures demonstrating that the colorimetric shift is visible on a paper substrate. The test was performed for 10 minutes at 37 degrees C. on glass fiber 934-AH.

FIG. 50 shows the amino acid sequence of the higher eukaryotes and prokaryotes nucleotide-binding (HEPN) domains of selected C2c2 orthologues (SEQ. I.D. Nos. 204-233).

FIG. 52A shows a schematic of SHERLOCK detection of ZIKV RNA isolated from human clinical samples. FIG. 52B is a graph showing that SHERLOCK is capable of highly sensitive detection of human ZIKV-positive serum (S) or urine (U) samples. Approximate concentrations of ZIKV RNA shown were determined by qPCR. (n=4 technical replicates, two-tailed Student t-test; ****, p<0.0001; bars represent mean±s.e.m.; n.d., not detected).

FIG. 54A is a graph showing digital-droplet PCR quantitation of ssRNA 1. Adjusted concentrations for the dilutions based on the ddPCR results are shown above bar graphs. FIG. 54B is a graph showing PCR quantitation of ssDNA 1. Adjusted concentrations for the dilutions based on the ddPCR results are shown above bar graphs. FIG. 54C is a graph showing that RPA, T7 transcription, and Cas13a detection reactions are compatible and achieve single molecule detection of DNA 2 when incubated simultaneously\ (n=3 technical replicates, two-tailed Student t-test; n.s., not significant; , p<0.01; **, p<0.0001; bars represent mean±s.e.m.).

FIG. 55A is a graph showing detection analysis of ssDNA 1 dilution series with digital-droplet PCR (n=4 technical replicates, two-tailed Student t-test; n.s., not significant; *, p<0.05; , p<0.01; , p<0.0001; red lines represent mean, bars represent mean±s.e.m. Samples with measured copy/µL below 10-1 not shown). FIG. 55B is a graph showing detection analysis of ssDNA 1 dilution series with quantitative PCR (n=16 technical replicates, two-tailed Student t-test; n.s., not significant; , p<0.01; ****, p<0.0001; red lines represent mean, bars represent mean±s.e.m. Samples with relative signal below 10-10 not shown). FIG. 55C is a graph showing detection analysis of ssDNA 1 dilution series with RPA with SYBR Green II (n=4 technical replicates, two-tailed Student t-test; *, p<0.05; , p<0.01; red lines represent mean, bars represent mean±s.e.m. Samples with relative signal below 100 not shown). FIG. 55D is a graph showing detection analysis of ssDNA 1 dilution series with SHERLOCK (n=4 technical replicates, two-tailed Student t-test; , p<0.01; ****, p<0.0001; red lines represent mean, bars represent mean±s.e.m. Samples with relative signal below 100 not shown). FIG. 55E is a graph showing percent coefficient of variation for a series of ssDNA 1 dilutions for four types of detection methods. FIG. 55F is a graph showing mean percent coefficient of variation for the 6e2, 6e1, 6e0, and 6e-1 ssDNA 1 dilutions for four types of detection methods (bars represent mean±s.e.m.).

FIGS. 57A-57G illustrate characterization of LwCas13a sensitivity to truncated spacers and single mismatches in the target sequence. FIG. 57A shows sequences of truncated spacer crRNAs (SEQ. I.D. Nos. 425-436) used in FIGS. 57B to 57G. Also shown are sequences of ssRNA 1 and 2, which has a single base-pair difference highlighted in red. crRNAs containing synthetic mismatches are displayed with mismatch positions colored in red. FIG. 57B is a graph showing collateral cleavage activity on ssRNA 1 and 2 for 28 nt spacer crRNA with synthetic mismatches at positions 1-7 (n=4 technical replicates; bars represent mean±s.e.m.). FIG. 57C is a graph showing specificity ratios of crRNA tested in FIG. 57B. Specificity ratios are calculated as the ratio of the on-target RNA (ssRNA 1) collateral cleavage to the off-target RNA (ssRNA 2) collateral cleavage. (n=4 technical replicates; bars represent mean±s.e.m.) FIG. 57D is a graph showing collateral cleavage activity on ssRNA 1 and 2 for 23 nt spacer crRNA with synthetic mismatches at positions 1-7 (n=4 technical replicates; bars represent mean±s.e.m.). FIG. 57E is a graph showing specificity ratios of crRNA tested in FIG. 57D. Specificity ratios are calculated as the ratio of the on-target RNA (ssRNA 1) collateral cleavage to the off-target RNA (ssRNA 2) collateral cleavage (n=4 technical replicates; bars represent mean±s.e.m.). FIG. 57F is a graph showing collateral cleavage activity on ssRNA 1 and 2 for 20 nt spacer crRNA with synthetic mismatches at positions 1-7 (n=4 technical replicates; bars represent mean s.e.m.). FIG. 57G is a graph showing specificity ratios of crRNA tested in FIG. 57F. Specificity ratios are calculated as the ratio of the on-target RNA (ssRNA 1) collateral cleavage to the off-target RNA (ssRNA 2) collateral cleavage (n=4 technical replicates; bars represent mean±s.e.m.).

FIGS. 58A-58C illustrate the identification of ideal synthetic mismatch position relative to mutations in the target sequence. FIG. 58A shows sequences for evaluation of the ideal synthetic mismatch position to detect a mutation between ssRNA 1 and ssRNA (SEQ. I.D. Nos. 437-462). On each of the targets, crRNAs with synthetic mismatches at the colored (red) locations are tested. Each set of synthetic mismatch crRNAs is designed such that the mutation location is shifted in position relative to the sequence of the spacer. Spacers are designed such that the mutation is evaluated at positions 3, 4, 5, and 6 within the spacer. FIG. 58B is a graph showing collateral cleavage activity on ssRNA 1 and 2 for crRNAs with synthetic mismatches at varying positions. There are four sets of crRNAs with the mutation at either position 3, 4, 5, or 6 within the spacer: target duplex region (n=4 technical replicates; bars represent mean±s.e.m.). FIG. 58C is a graph showing specificity ratios of crRNA tested in FIG. 58B. Specificity ratios are calculated as the ratio of the on-target RNA (ssRNA 1) collateral cleavage to the off-target RNA (ssRNA 2) collateral cleavage (n=4 technical replicates; bars represent mean±s.e.m.).

FIG. 60A is a graph showing genotyping with SHERLOCK at the rs601338 SNP site for each of the four individuals compared against PCR-amplified genotype standards (n=4 technical replicates; bars represent mean±s.e.m.). FIG. 60B is a graph illustrating genotyping with SHERLOCK at the rs4363657 SNP site for each of the four individuals compared against PCR-amplified genotype standards (n=4 technical replicates; bars represent mean±s.e.m.). FIG. 60C shows heatmaps of computed p-values between the SHERLOCK results for each individual and the synthetic standards at the rs601338 SNP site. A heatmap is shown for each of the allele-sensing crRNAs. The heatmap color map is scaled such that insignificance (p>0.05) is red and significance (p<0.05) is blue (n=4 technical replicates, one-way ANOVA). FIG. 60D shows heatmaps of computed p-values between the SHERLOCK results for each individual and the synthetic standards at the rs4363657 SNP site. A heatmap is shown for each of the allele-sensing crRNAs. The heatmap color map is scaled such that insignificance (p>0.05) is red and significance (p<0.05) is blue (n=4 technical replicates, one-way ANOVA). FIG. 60E is a guide for understanding the p-value heatmap results of SHERLOCK genotyping. Genotyping can easily be called by choosing the allele that corresponds to a p-value>0.05 between the individual and allelic synthetic standards. Red blocks correspond to non-significant differences between the synthetic standard and individual's SHERLOCK result and thus a genotype-positive result. Blue blocks correspond to significant differences between the synthetic standard and individual's SHERLOCK result and thus a genotype-negative result.

FIG. 78—provides relative cleavage activity at different nucleotides of various Cas13b orthologs and relative to a LwaCas13a.

FIGS. 81A-81D—provides schematic of a multiplex assay using Cas13 orthologs with different editing preferences and polyN based masking constructs. Data are shown in (FIGS. 81B and 81D) graph and (FIG. 81C) heatmap format.

FIGS. 83A-83H illustrate the biochemical characterization of the Cas13b family of RNA-guided RNA-targeting enzymes and increased sensitivity and quantitative SHERLOCK. FIG. 83A shows a schematic of the CRISPR-Cas13 loci and crRNA structure. FIG. 83B is a heatmap of the base preference of 15 Cas13b orthologs targeting ssRNA 1 with sensor probes consisting of a hexamer homopolymer of A, C, G, or U bases. FIG. 83C is a schematic of cleavage motif preference discovery screen and preferred two-base motifs for LwaCas13a and PsmCas13b. Values represented in the heatmap are the counts of each two-base across all depleted motifs. Motifs are considered depleted if the −log2(target/no target) value is above 1.0 in the LwaCas13a condition or 0.5 in the PsmCas13b condition. In the −log2(target/no target) value, target and no target denote the frequency of a motif in the target and no target conditions, respectively. FIG. 83D is a graph showing orthogonal base preferences of PsmCas13b and LwaCas13a targeting ssRNA 1 with either a U6 or A6 sensor probe. FIG. 83E illustrates graphs showing single molecule SHERLOCK detection with LwaCas13a and PsmCas13b targeting Dengue ssRNA target. FIG. 83F illustrates graphs showing single molecule SHERLOCK detection with LwaCas13a and PsmCas13b in large reaction volumes for increased sensitivity targeting ssRNA target 1. FIG. 83G is a graph showing quantitation of *P. aeruginosa* synthetic DNA at various RPA primer concentrations. FIG. 83H is a graph showing correlation of *P. aeruginosa* synthetic DNA concentration with detected fluorescence.

FIGS. 84A-84H illustrate in-sample multiplexing SHERLOCK with orthogonal Cas13 enzymes. FIG. 84A is a schematic of in-sample multiplexing using orthogonal Cas13 enzymes. FIG. 84B is a graph showing in-sample multiplexed detection of 20 nM Zika and Dengue synthetic RNA with LwaCas13a and PsmCas13b collateral activity. FIG. 84C illustrates heatmaps showing multiplexed RPA and collateral detection at decreasing concentrations of *S. aureus* thermonuclease and *P. aeruginosa* acyltransferase synthetic targets with LwaCas13a and PsmCas13b. FIG. 84D is a graph showing multiplexed genotyping with human samples at rs601338 with LwaCas13a and CcaCas13b. FIG. 84E is a schematic of theranostic timeline for detection of disease alleles, correction with REPAIR, and assessment of REPAIR correction. FIG. 84F is a graph showing in-sample multiplexed detection of APC alleles from healthy- and disease-simulating samples with LwaCas13a and PsmCas13b. FIG. 84G is a graph showing quantitation of REPAIR editing efficiency at the targeted APC mutation. FIG. 84H is a graph showing multiplexed detection of APC alleles from REPAIR targeting and non-targeting samples with LwaCas13a and PsmCas13b.

FIGS. 86A-86C illustrate protein purification of Cas13 orthologs. FIG. 86A shows chromatograms of size exclusion chromatography for Cas13b, LwCas13a and LbaCas13a used in this study. Measured UV absorbance (mAU) is shown against the elution volume (ml). FIG. 86B shows an SDS-PAGE gel of purified Cas13b orthologs. Fourteen Cas13b orthologs are loaded from left to right. A protein ladder is shown to the left. FIG. 86C shows a final SDS-PAGE gel of LbaCas13a dilutions (right) and BSA standard titration (left). Five dilutions of BSA and two of LbaCas13 are shown.

FIG. 87A is a graph showing cleavage activity of fourteen Cas13b orthologs targeting ssRNA 1 using a homopolymer adenine sensor six nucleotides long. FIG. 87B is a graph showing cleavage activity of fourteen Cas13b orthologs targeting ssRNA 1 using a homopolymer uridine sensor six nucleotides long. FIG. 87C is a graph showing cleavage activity of fourteen Cas13b orthologs targeting ssRNA 1 using a homopolymer guanine sensor six nucleotides long. FIG. 87D is a graph showing cleavage activity of fourteen Cas13b orthologs targeting ssRNA 1 using a homopolymer cytidine sensor six nucleotides long.

FIGS. 89A-89D show a representation of various motifs after cleavage by RNases. FIG. 89A shows box plots showing motif distribution of target to no-target ratios for LwaCas13a, PsmCas13b, CcaCas13b, and RNase A at 5 minute and 60 minute timepoints. RNase A ratios were compared to the average of the three Cas13 no-target conditions. Ratios are also an average of two cleavage reaction replicates. FIG. 89B is a graph showing number of enriched motifs for LwaCas13a, PsmCas13b, CcaCas13b, and RNase A at the 60 minute timepoint. Enrichment motif was calculated as motifs above −log2(target/no target) thresholds of either 1 (LwaCas13a, CcaCas13b, and RNase A) or 0.5 (PsmCas13b). A threshold of 1 corresponds to at least 50% depletion while a threshold of 0.5 corresponds to at least 30% depletion. FIG. 89C shows sequence logos generated from enriched motifs for LwaCas13a, PsmCas13b, and CcaCas13b. LwaCas13a and CcaCas13b show a strong U preference as would be expected, while PsmCas13b shows a unique preference for A bases across the motif, which is consistent with homopolymer collateral activity preferences. FIG. 89D is a heatmap showing the orthogonal motif preferences of LwaCas13a, PsmCas13b, and CcaCas13b. Values represented in the heatmap are the $-\log_2$(target/no target) value of each shown motif. In the $-\log_2$(target/no target) value, target and no target denote the frequency of a motif in the target and no target conditions, respectively.

FIG. 90A illustrates heatmaps showing single base preferences for LwaCas13a, PsmCas13b, CcaCas13b, and RNase A at the 60 minute timepoint as determined by the random motif library cleavage screen. Values represented in the heatmap are the counts of each base across all depleted motifs. Motifs are considered depleted if the $-\log_2$(target/no target) value is above 1.0 in the LwaCas13a, CcaCas13b, and RNase A conditions or 0.5 in the PsmCas13b condition. In the $-\log_2$(target/no target) value, target and no target denote the frequency of a motif in the target and no target conditions, respectively. FIG. 90B is a heatmap showing two-base preference for CcaCas13b as determined by the random motif library cleavage screen. Values represented in the heatmap are the counts of each 2-base across all depleted motifs. Motifs are considered depleted if the $-\log_2$(targetlno target) value is above 1.0 in the LwaCas13a, CcaCas13b, and RNase A conditions or 0.5 in the PsmCas13b condition. In the $-\log_2$(target/no target) value, target and no target denote the frequency of a motif in the target and no target conditions, respectively. FIG. 90C is a heatmap showing two-base preference for RNase A as determined by the random motif library cleavage screen. Values represented in the heatmap are the counts of each two-base across all depleted motifs. Motifs are considered depleted if the $-\log_2$(target/no target) value is above 1.0 in the LwaCas13a, CcaCas13b, and RNase A conditions or 0.5 in the PsmCas13b condition. In the $-\log_2$(target/no target) value, target and no target denote the frequency of a motif in the target and no target conditions, respectively.

FIGS. 93A-93C show results of testing base cleavage preferences of Cas13 orthologs with in vitro cleavage of poly-X substrates. FIG. 93A illustrates in vitro cleavage of poly-U, C, G, and A targets with LwaCas13a incubated with and without crRNA. FIG. 93B illustrates in vitro cleavage of poly-U, C, G, and A targets with CcaCas13b incubated with and without crRNA. FIG. 93C illustrates in vitro cleavage of poly-U, C, G, and A targets with PsmCas13b incubated with and without crRNA.

FIG. 94A. A variety of buffers are tested for their effect on PsmCas13b collateral activity after targeting ssRNA 1. FIG. 94B. The optimized buffer is compared to the original buffer at different PsmCas13b-crRNA complex concentrations.

FIG. 95A. Cleavage activity of PsmCas13b with a fluorescent poly U sensor for divalent cations Ca, Co, Cu, Mg, Mn, Ni, and Zn. PsmCas13b is incubated with a crRNA targeting a synthetic Dengue ssRNA. FIG. 95B. Cleavage activity of PsmCas13b with a fluorescent poly A sensor for divalent cations Ca, Co, Cu, Mg, Mn, Ni, and Zn. PsmCas13b is incubated with a crRNA targeting a synthetic Dengue ssRNA. FIG. 95C. Cleavage activity of Pin2Cas13b with a fluorescent poly U sensor for divalent cations Ca, Co, Cu, Mg, Mn, Ni, and Zn. Pin2Cas13b is incubated with a crRNA targeting a synthetic Dengue ssRNA. FIG. 95D. Cleavage activity of Pin2Cas13b with a fluorescent poly A sensor for divalent cations Ca, Co, Cu, Mg, Mn, Ni, and Zn. Pin2Cas13b is incubated with a crRNA targeting a synthetic Dengue ssRNA. FIG. 95E. Cleavage activity of CcaCas13b with a fluorescent poly U sensor for divalent cations Ca, Co, Cu, Mg, Mn, Ni, and Zn. CcaCas13b is incubated with a crRNA targeting a synthetic Dengue ssRNA. FIG. 95F. Cleavage activity of CcaCas13b with a fluorescent poly A sensor for divalent cations Ca, Co, Cu, Mg, Mn, Ni, and Zn. CcaCas13b is incubated with a crRNA targeting a synthetic Dengue ssRNA.

FIG. 96A. Cleavage activity of PsmCas13b and LbaCas13a incubated with respective crRNAs targeting a synthetic Zika target at different concentrations (n=4 technical replicates, two-tailed Student t-test; n.s., not significant; *, p<0.05; , p<0.01; *, p<0.001; ****, p<0.0001; bars represent mean±s.e.m.). FIG. 96B. Cleavage activity of PsmCas13b and LbaCas13a incubated with respective crRNAs targeting a synthetic Dengue target at different concentrations (n=4 technical replicates, two-tailed Student t-test; n.s., not significant; *, p<0.05; , p<0.01; *, p<0.001; ****, p<0.0001; bars represent mean±s.e.m.).

FIG. 97A. SHERLOCK detection of Zika ssRNA at different concentrations with LwaCas13a and poly U sensor. FIG. 97B. SHERLOCK detection of Zika ssRNA at different concentrations with PsmCas13b and poly A sensor.

FIG. 99A. Cleavage activity of LwaCas13a and CcaCas13b with crRNAs tiled across ssRNA 1. FIG. 99B. Cleavage activity of PsmCas13b with crRNAs tiled across ssRNA 1.

FIG. 100A. Cleavage activity of PsmCas13b with ssRNA 1-targeting crRNAs of varying spacer lengths. FIG. 100B. Cleavage activity of CcaCas13b with ssRNA 1-targeting crRNAs of varying spacer lengths.

FIG. 101A. SHERLOCK kinetic curves of LwaCas13a incubated with Zika RNA targets of different concentration and a complementary crRNA at an RPA primer concentration of 480 nM. FIG. 101B. SHERLOCK kinetic curves of LwaCas13a incubated with Zika RNA targets of different concentration and a complementary crRNA at an RPA primer concentration of 240 nM. FIG. 101C. SHERLOCK kinetic curves of LwaCas13a incubated with Zika RNA targets of different concentration and a complementary crRNA at an RPA primer concentration of 120 nM. FIG. 101D. SHERLOCK kinetic curves of LwaCas13a incubated with Zika RNA targets of different concentration and a complementary crRNA at an RPA primer concentration of 24 nM. FIG. 101E. SHERLOCK detection of Zika RNA of different concentrations with four different RPA primer concentrations: 480 nM, 240 nM, 120 nM, 60 nM, and 24 nM. FIG. 101F. The mean $R^2$ correlation between background subtracted fluorescence of SHERLOCK and the Zika target RNA concentration at different RPA primer concentrations. FIG. 101G. Quantitative SHERLOCK detection of Zika RNA targets at different concentrations in a 10-fold dilution series (black points) and 2-fold dilution series (red points). An RPA primer concentration of 120 nM was used.

FIG. 102A. Multiplexed two-color detection using LwaCas13a targeting a Zika ssRNA target and PsmCas13b targeting a Dengue ssRNA target. Both targets are at 20 nM input. All Data shown represent 180 minutes time point of reaction. FIG. 102B. Multiplexed two-color detection using LwaCas13a targeting a Zika ssRNA target and PsmCas13b targeting a Dengue ssRNA target. Both targets are at 200 pM input. FIG. 102C. In-sample multiplexed detection of 20 pM Zika and Dengue synthetic RNA with CcaCas13a and PsmCas13b collateral activity.

FIG. 104A. Detection of APC alleles from healthy- and disease-simulated samples with LwaCas13a. FIG. 104B. Detection with LwaCas13a of editing correction at the APC alleles from REPAIR targeting and non-targeting samples.

FIG. 105A is a schematic of gold-nanoparticle based colorimetric readout for RNase activity. In the absence of RNase activity, RNA linkers aggregate gold nanoparticles, leading to loss of red color. Cleavage of RNA linkers releases nanoparticles and results in a red color change. FIG. 105B is an image of colorimetric reporters after 120 minutes of RNase digestion at various units of RNase A. FIG. 105C is a graph showing kinetics at 520 nm absorbance of AuNP colorimetric reporters with digestion at various unit concentrations of RNase A. FIG. 105D is a graph showing 520 nm absorbance of AuNP colorimetric reporters after 120 minutes of digestion at various unit concentrations of RNase A. FIG. 105E is a graph showing time to half-A520 maximum of AuNP colorimetric reporters with digestion at various unit concentrations of RNase A.

FIGS. 106A-106C illustrate quantitative detection of CP4-EPSPS gene from soybean genomic DNA. FIG. 106A is a graph showing mean correlation $R^2$ of the SHERLOCK background subtracted fluorescence and CP4-EPSPS bean percentage at different time points of detection. Bean percentage depicts the amount of round-up ready beans in a mixture of round-up ready and wild-type beans. The CP4-EPSPS gene is only present in round-up ready beans. FIG. 106B is a graph showing SHERLOCK detection of CP4-EPSPS resistance gene at different bean percentages showing the quantitative nature of SHERLOCK detection at 30 minutes of incubation. FIG. 106C is a graph showing SHERLOCK detection of Lectin gene at different bean percentages. Bean percentage depicts the amount of round-up ready beans in a mixture of round-up ready and wild-type beans. The Lectin gene is present in both types of beans and therefore shows no correlation to round-up ready bean percentage.

DETAILED DESCRIPTION OF THE EXAMPLE EMBODIMENTS

General Definitions

Figure 1:
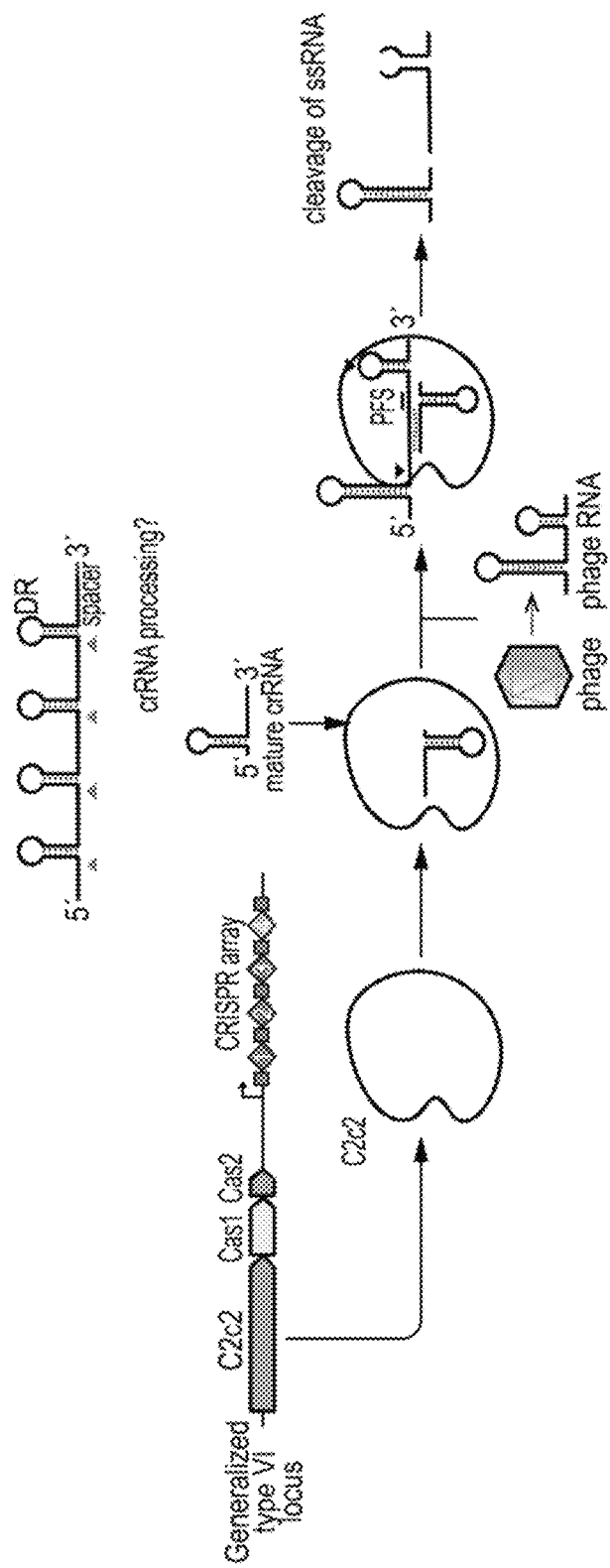
FIG. 1—is a schematic of an example C2c2 based CRISPR effector system.

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, $2^{nd}$ edition (1989) (Sambrook, Fritsch, and Maniatis); Molecular Cloning: A Laboratory Manual, $4^{th}$ edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratory Manual, $2^{nd}$ edition 2013 (E. A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, $2^{nd}$ edition (2011).

As used herein, the singular forms "a", "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

"C2c2" is now referred to as "Cas13a", and the terms are used interchangeably herein unless indicated otherwise.

All publications, published patent documents, and patent applications cited herein are hereby incorporated by reference to the same extent as though each individual publication, published patent document, or patent application was specifically and individually indicated as being incorporated by reference.

Overview

Microbial Clustered Regularly Interspaced Short Palindromic Repeats (CRISPR) and CRISPR-associated (CRISPR-Cas) adaptive immune systems contain programmable endonucleases, such as Cas9 and Cpf1 (Shmakov et al., 2017; Zetsche et al., 2015). Although both Cas9 and Cpf1 target DNA, single effector RNA-guided RNases have been recently discovered (Shmakov et al., 2015) and characterized (Abudayyeh et al., 2016; Smargon et al., 2017), including C2c2, providing a platform for specific RNA sensing. RNA-guided RNases can be easily and conveniently reprogrammed using CRISPR RNA (crRNAs) to cleave target RNAs. Unlike the DNA endonucleases Cas9 and Cpf1, which cleave only its DNA target, RNA-guided RNases, like C2c2, remains active after cleaving its RNA target, leading to "collateral" cleavage of non-targeted RNAs in proximity (Abudayyeh et al., 2016). This crRNA-programmed collateral RNA cleavage activity presents the opportunity to use RNA-guided RNases to detect the presence of a specific RNA by triggering in vivo programmed cell death or in vitro nonspecific RNA degradation that can serve as a readout (Abudayyeh et al., 2016; East-Seletsky et al., 2016).

The embodiments disclosed herein utilized RNA targeting effectors to provide a robust CRISPR-based diagnostic with attomolar sensitivity. Embodiments disclosed herein can detect broth DNA and RNA with comparable levels of sensitivity and can differentiate targets from non-targets based on single base pair differences. Moreover, the embodiments disclosed herein can be prepared in freeze-dried format for convenient distribution and point-of-care (POC) applications. Such embodiments are useful in multiple scenarios in human health including, for example, viral detection, bacterial strain typing, sensitive genotyping, and detection of disease-associated cell free DNA. For ease of reference, the embodiments disclosed herein may also be referred to as SHERLOCK (Specific High-sensitivity Enzymatic Reporter unLOCKing).

In one aspect, the embodiments disclosed herein are directed to a nucleic acid detection system comprising a CRISPR system, one or more guide RNAs designed to bind to corresponding target molecules, a masking construct, and optional amplification reagents to amplify target nucleic acid molecules in a sample. In certain example embodiments, the system may further comprise one or more detection aptamers. The one or more detection aptamers may comprise a RNA polymerase site or primer binding site. The one or more detection aptamers specifically bind one or more target polypeptides and are configured such that the RNA polymerase site or primer binding site is exposed only upon binding of the detection aptamer to a target peptide. Exposure of the RNA polymerase site facilitates generation of a trigger RNA oligonucleotide using the aptamer sequence as a template. Accordingly, in such embodiments the one or more guide RNAs are configured to bind to a trigger RNA.

In another aspect, the embodiments disclosed herein are directed to a diagnostic device comprising a plurality of individual discrete volumes. Each individual discrete volume comprises a CRISPR effector protein, one or more guide RNAs designed to bind to a corresponding target molecule, and a masking construct. In certain example embodiments, RNA amplification reagents may be pre-loaded into the individual discrete volumes or be added to the individual discrete volumes concurrently with or subsequent to addition of a sample to each individual discrete volume. The device may be a microfluidic based device, a wearable device, or device comprising a flexible material substrate on which the individual discrete volumes are defined.

In another aspect, the embodiments disclosed herein are directed to a method for detecting target nucleic acids in a sample comprising distributing a sample or set of samples into a set of individual discrete volumes, each individual discrete volume comprising a CRISPR effector protein, one or more guide RNAs designed to bind to one target oligonucleotides, and a masking construct. The set of samples are then maintained under conditions sufficient to allow binding of the one or more guide RNAs to one or more target molecules. Binding of the one or more guide RNAs to a target nucleic acid in turn activates the CRISPR effector protein. Once activated, the CRISPR effector protein then deactivates the masking construct, for example, by cleaving the masking construct such that a detectable positive signal is unmasked, released, or generated. Detection of the positive detectable signal in an individual discrete volume indicates the presence of the target molecules.

In yet another aspect, the embodiments disclosed herein are directed to a method for detecting polypeptides. The method for detecting polypeptides is similar to the method for detecting target nucleic acids described above. However, a peptide detection aptamer is also included. The peptide detection aptamers function as described above and facilitate generation of a trigger oligonucleotide upon binding to a target polypeptide. The guide RNAs are designed to recognize the trigger oligonucleotides thereby activating the CRISPR effector protein. Deactivation of the masking construct by the activated CRISPR effector protein leads to unmasking, release, or generation of a detectable positive signal.

Crispr Effector Proteins

In general, a CRISPR-Cas or CRISPR system as used in herein and in documents, such as WO 2014/093622 (PCT/US2013/074667), refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). When the CRISPR protein is a C2c2 protein, a tracrRNA is not required. C2c2 has been described in Abudayyeh et al. (2016) "C2c2 is a single-component programmable RNA-guided RNA-targeting CRISPR effector"; Science; DOI: 10.1126/science.aaf5573; and Shmakov et al. (2015) "Discovery and Functional Characterization of Diverse Class 2 CRISPR-Cas Systems", Molecular Cell, DOI: dx.doi.org/10.1016/j.molcel.2015.10.008; which are incorporated herein in their entirety by reference. Cas13b has been described in Smargon et al. (2017) "Cas13b Is a Type VI-B CRISPR-Associated RNA-Guided RNases Differentially Regulated by Accessory Proteins Csx27 and Csx28," Molecular Cell. 65, 1-13; dx.doi.org/10.1016/j.molcel.2016.12.023., which is incorporated herein in its entirety by reference.

In certain embodiments, a protospacer adjacent motif (PAM) or PAM-like motif directs binding of the effector protein complex as disclosed herein to the target locus of interest. In some embodiments, the PAM may be a 5' PAM (i.e., located upstream of the 5' end of the protospacer). In other embodiments, the PAM may be a 3' PAM (i.e., located downstream of the 5' end of the protospacer). The term "PAM" may be used interchangeably with the term "PFS" or "protospacer flanking site" or "protospacer flanking sequence".

In a preferred embodiment, the CRISPR effector protein may recognize a 3' PAM. In certain embodiments, the CRISPR effector protein may recognize a 3' PAM which is 5'H, wherein H is A, C or U. In certain embodiments, the effector protein may be Leptotrichia shahii C2c2p, more preferably Leptotrichia shahii DSM 19757 C2c2, and the 3' PAM is a 5' H.

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to a RNA polynucleotide being or comprising the target sequence. In other words, the target RNA may be a RNA polynucleotide or a part of a RNA polynucleotide to which a part of the gRNA, i.e. the guide sequence, is designed to have complementarity and to which the effector function mediated by the complex comprising CRISPR effector protein and a gRNA is to be directed. In some embodiments, a target sequence is located in the nucleus or cytoplasm of a cell.

The nucleic acid molecule encoding a CRISPR effector protein, in particular C2c2, is advantageously codon optimized CRISPR effector protein. An example of a codon optimized sequence, is in this instance a sequence optimized for expression in eukaryotes, e.g., humans (i.e. being optimized for expression in humans), or for another eukaryote, animal or mammal as herein discussed; see, e.g., SaCas9 human codon optimized sequence in WO 2014/093622 (PCT/US2013/074667). Whilst this is preferred, it will be appreciated that other examples are possible and codon optimization for a host species other than human, or for codon optimization for specific organs is known. In some embodiments, an enzyme coding sequence encoding a CRISPR effector protein is a codon optimized for expression in particular cells, such as eukaryotic cells. The eukaryotic cells may be those of or derived from a particular organism, such as a plant or a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at kazusa.orjp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding a Cas correspond to the most frequently used codon for a particular amino acid.

In certain embodiments, the methods as described herein may comprise providing a Cas transgenic cell, in particular a C2c2 transgenic cell, in which one or more nucleic acids encoding one or more guide RNAs are provided or introduced operably connected in the cell with a regulatory element comprising a promoter of one or more gene of interest. As used herein, the term "Cas transgenic cell" refers to a cell, such as a eukaryotic cell, in which a Cas gene has been genomically integrated. The nature, type, or origin of the cell are not particularly limiting according to the present invention. Also the way the Cas transgene is introduced in the cell may vary and can be any method as is known in the art. In certain embodiments, the Cas transgenic cell is obtained by introducing the Cas transgene in an isolated cell. In certain other embodiments, the Cas transgenic cell is obtained by isolating cells from a Cas transgenic organism. By means of example, and without limitation, the Cas transgenic cell as referred to herein may be derived from a Cas transgenic eukaryote, such as a Cas knock-in eukaryote. Reference is made to WO 2014/093622 (PCT/US13/74667), incorporated herein by reference. Methods of US Patent Publication Nos. 20120017290 and 20110265198 assigned to Sangamo BioSciences, Inc. directed to targeting the Rosa locus may be modified to utilize the CRISPR Cas system of the present invention. Methods of US Patent Publication No. 20130236946 assigned to Cellectis directed to targeting the Rosa locus may also be modified to utilize the CRISPR Cas system of the present invention. By means of further example reference is made to Platt et. al. (Cell; 159(2):440-455 (2014)), describing a Cas9 knock-in mouse, which is incorporated herein by reference. The Cas transgene can further comprise a Lox-Stop-polyA-Lox(LSL) cassette thereby rendering Cas expression inducible by Cre recombinase. Alternatively, the Cas transgenic cell may be obtained by introducing the Cas transgene in an isolated cell. Delivery systems for transgenes are well known in the art. By means of example, the Cas transgene may be delivered in for instance eukaryotic cell by means of vector (e.g., AAV, adenovirus, lentivirus) and/or particle and/or nanoparticle delivery, as also described herein elsewhere.

It will be understood by the skilled person that the cell, such as the Cas transgenic cell, as referred to herein may comprise further genomic alterations besides having an integrated Cas gene or the mutations arising from the sequence specific action of Cas when complexed with RNA capable of guiding Cas to a target locus.

In certain aspects the invention involves vectors, e.g. for delivering or introducing in a cell Cas and/or RNA capable of guiding Cas to a target locus (i.e. guide RNA), but also for propagating these components (e.g. in prokaryotic cells). A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety. Thus, the embodiments disclosed herein may also comprise transgenic cells comprising the CRISPR effector system. In certain example embodiments, the transgenic cell may function as an individual discrete volume. In other words samples comprising a masking construct may be delivered to a cell, for example in a suitable delivery vesicle and if the target is present in the delivery vesicle the CRISPR effector is activated and a detectable signal generated.

The vector(s) can include the regulatory element(s), e.g., promoter(s). The vector(s) can comprise Cas encoding sequences, and/or a single, but possibly also can comprise at least 3 or 8 or 16 or 32 or 48 or 50 guide RNA(s) (e.g., sgRNAs) encoding sequences, such as 1-2, 1-3, 1-4 1-5, 3-6, 3-7, 3-8, 3-9, 3-10, 3-8, 3-16, 3-30, 3-32, 3-48, 3-50 RNA(s) (e.g., sgRNAs). In a single vector there can be a promoter for each RNA (e.g., sgRNA), advantageously when there are up to about 16 RNA(s); and, when a single vector provides for more than 16 RNA(s), one or more promoter(s) can drive expression of more than one of the RNA(s), e.g., when there are 32 RNA(s), each promoter can drive expression of two RNA(s), and when there are 48 RNA(s), each promoter can drive expression of three RNA(s). By simple arithmetic and well established cloning protocols and the teachings in this disclosure one skilled in the art can readily practice the invention as to the RNA(s) for a suitable exemplary vector such as AAV, and a suitable promoter such as the U6 promoter. For example, the packaging limit of AAV is ~4.7 kb. The length of a single U6-gRNA (plus restriction sites for cloning) is 361 bp. Therefore, the skilled person can readily fit about 12-16, e.g., 13 U6-gRNA cassettes in a single vector. This can be assembled by any suitable means, such as a golden gate strategy used for TALE assembly (genome-engineering.org/taleffectors/). The skilled person can also use a tandem guide strategy to increase the number of U6-gRNAs by approximately 1.5 times, e.g., to increase from 12-16, e.g., 13 to approximately 18-24, e.g., about 19 U6-gRNAs. Therefore, one skilled in the art can readily reach approximately 18-24, e.g., about 19 promoter-RNAs, e.g., U6-gRNAs in a single vector, e.g., an AAV vector. A further means for increasing the number of promoters and RNAs in a vector is to use a single promoter (e.g., U6) to express an array of RNAs separated by cleavable sequences. And an even further means for increasing the number of promoter-RNAs in a vector, is to express an array of promoter-RNAs separated by cleavable sequences in the intron of a coding sequence or gene; and, in this instance it is advantageous to use a polymerase II promoter, which can have increased expression and enable the transcription of long RNA in a tissue specific manner. (see, e.g., nar.oxford-journals.org/content/34/7/e53. short and nature.com/mt/journal/v16/n9/abs/mt2008144a.html). In an advantageous embodiment, AAV may package U6 tandem gRNA targeting up to about 50 genes. Accordingly, from the knowledge in the art and the teachings in this disclosure the skilled person can readily make and use vector(s), e.g., a single vector, expressing multiple RNAs or guides under the control or operatively or functionally linked to one or more promoters—especially as to the numbers of RNAs or guides discussed herein, without any undue experimentation.

The guide RNA(s) encoding sequences and/or Cas encoding sequences, can be functionally or operatively linked to regulatory element(s) and hence the regulatory element(s) drive expression. The promoter(s) can be constitutive promoter(s) and/or conditional promoter(s) and/or inducible promoter(s) and/or tissue specific promoter(s). The promoter can be selected from the group consisting of RNA polymerases, pol I, pol II, pol III, T7, U6, H1, retroviral Rous sarcoma virus (RSV) LTR promoter, the cytomegalovirus (CMV) promoter, the SV40 promoter, the dihydrofolate reductase promoter, the β-actin promoter, the phosphoglycerol kinase (PGK) promoter, and the EF1α promoter. An advantageous promoter is the promoter is U6.

In some embodiments, one or more elements of a nucleic acid-targeting system is derived from a particular organism comprising an endogenous CRISPR RNA-targeting system. In certain example embodiments, the effector protein CRISPR RNA-targeting system comprises at least one HEPN domain, including but not limited to the HEPN domains described herein, HEPN domains known in the art, and domains recognized to be HEPN domains by comparison to consensus sequence motifs. Several such domains are provided herein. In one non-limiting example, a consensus sequence can be derived from the sequences of C2c2 or Cas13b orthologs provided herein. In certain example embodiments, the effector protein comprises a single HEPN domain. In certain other example embodiments, the effector protein comprises two HEPN domains.

In one example embodiment, the effector protein comprise one or more HEPN domains comprising a RxxxxH motif sequence. The RxxxxH motif sequence can be, without limitation, from a HEPN domain described herein or a HEPN domain known in the art. RxxxxH motif sequences further include motif sequences created by combining portions of two or more HEPN domains. As noted, consensus sequences can be derived from the sequences of the orthologs disclosed in U.S. Provisional Patent Application 62/432,240 entitled "Novel CRISPR Enzymes and Systems," U.S. Provisional Patent Application 62/471,710 entitled "Novel Type VI CRISPR Orthologs and Systems" filed on Mar. 15, 2017, and U.S. Provisional Patent Application 62/484,791 filed Apr. 12, 2017 entitled "Novel Type VI CRISPR Orthologs and Systems".

In an embodiment of the invention, a HEPN domain comprises at least one RxxxxH motif comprising the sequence of R{N/H/K}X1X2X3H. In an embodiment of the invention, a HEPN domain comprises a RxxxxH motif comprising the sequence of R{N/H}X1X2X3H. In an embodiment of the invention, a HEPN domain comprises the sequence of R{N/K}X1X2X3H. In certain embodiments, X1 is R, S, D, E, Q, N, G, Y, or H. In certain embodiments, X2 is I, S, T, V, or L. In certain embodiments, X3 is L, F, N, Y, V, I, S, D, E, or A.

Additional effectors for use according to the invention can be identified by their proximity to Cas1 genes, for example, though not limited to, within the region 20 kb from the start of the Cas1 gene and 20 kb from the end of the Cas1 gene. In certain embodiments, the effector protein comprises at least one HEPN domain and at least 500 amino acids, and wherein the C2c2 effector protein is naturally present in a prokaryotic genome within 20 kb upstream or downstream of a Cas gene or a CRISPR array. Non-limiting examples of Cas proteins include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologues thereof, or modified versions thereof. In certain example embodiments, the C2c2 effector protein is naturally present in a prokaryotic genome within 20 kb upstream or downstream of a Cas 1 gene. The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related, or are only partially structurally related. An "orthologue" of a protein as used herein is a protein of a different species which performs the same or a similar function as the protein it is an orthologue of. Orthologous proteins may but need not be structurally related, or are only partially structurally related.

In particular embodiments, the Type VI RNA-targeting Cas enzyme is C2c2. In other example embodiments, the Type VI RNA-targeting Cas enzyme is Cas13b. In particular embodiments, the homologue or orthologue of a Type VI protein such as C2c2 as referred to herein has a sequence homology or identity of at least 30%, or at least 40%, or at least 50%, or at least 60%, or at least 70%, or at least 80%, more preferably at least 85%, even more preferably at least 90%, such as for instance at least 95% with a Type VI protein such as C2c2 (e.g., based on the wild-type sequence of any of Leptotrichia shahii C2c2, Lachnospiraceae bacterium MA2020 C2c2, Lachnospiraceae bacterium NK4A179 C2c2, *Clostridium aminophilum* (DSM 10710) C2c2, *Carnobacterium gallinarum* (DSM 4847) C2c2, Paludibacter propionicigenes (WB4) C2c2, *Listeria weihenstephanensis* (FSL R9-0317) C2c2, Listeriaceae bacterium (FSL M6-0635) C2c2, *Listeria newyorkensis* (FSL M6-0635) C2c2, *Leptotrichia wadei* (F0279) C2c2, *Rhodobacter capsulatus* (SB 1003) C2c2, *Rhodobacter capsulatus* (R121) C2c2, *Rhodobacter capsulatus* (DE442) C2c2, *Leptotrichia wadei* (Lw2) C2c2, or *Listeria seeligeri* C2c2). In further embodiments, the homologue or orthologue of a Type VI protein such as C2c2 as referred to herein has a sequence identity of at least 30%, or at least 40%, or at least 50%, or at least 60%, or at least 70%, or at least 80%, more preferably at least 85%, even more preferably at least 90%, such as for instance at least 95% with the wild type C2c2 (e.g., based on the wild-type sequence of any of Leptotrichia shahii C2c2, Lachnospiraceae bacterium MA2020 C2c2, Lachnospiraceae bacterium NK4A179 C2c2, *Clostridium*

*aminophilum* (DSM 10710) C2c2, *Carnobacterium gallinarum* (DSM 4847) C2c2, *Paludibacter propionicigenes* (WB4) C2c2, *Listeria weihenstephanensis* (FSL R9-0317) C2c2, Listeriaceae bacterium (FSL M6-0635) C2c2, *Listeria newyorkensis* (FSL M6-0635) C2c2, *Leptotrichia wadei* (F0279) C2c2, *Rhodobacter capsulatus* (SB 1003) C2c2, *Rhodobacter capsulatus* (R121) C2c2, *Rhodobacter capsulatus* (DE442) C2c2, *Leptotrichia wadei* (Lw2) C2c2, or *Listeria seeligeri* C2c2).

In certain other example embodiments, the CRISPR system the effector protein is a C2c2 nuclease. The activity of C2c2 may depend on the presence of two HEPN domains. These have been shown to be RNase domains, i.e. nuclease (in particular an endonuclease) cutting RNA. C2c2 HEPN may also target DNA, or potentially DNA and/or RNA. On the basis that the HEPN domains of C2c2 are at least capable of binding to and, in their wild-type form, cutting RNA, then it is preferred that the C2c2 effector protein has RNase function. Regarding C2c2 CRISPR systems, reference is made to U.S. Provisional 62/351,662 filed on Jun. 17, 2016 and U.S. Provisional 62/376,377 filed on Aug. 17, 2016. Reference is also made to U.S. Provisional 62/351,803 filed on Jun. 17, 2016. Reference is also made to U.S. Provisional 62/432,240 entitled "Novel Crispr Enzymes and Systems" filed Dec. 9, 2016 bearing Broad Institute No. 10035.PA4. Reference is further made to East-Seletsky et al. "Two distinct RNase activities of CRISPR-C2c2 enable guide-RNA processing and RNA detection" Nature doi:10/1038/nature19802 and Abudayyeh et al. "C2c2 is a single-component programmable RNA-guided RNA targeting CRISPR effector" bioRxiv doi:10.1101/054742.

RNase function in CRISPR systems is known, for example mRNA targeting has been reported for certain type In CRISPR-Cas systems (Hale et al., 2014, *Genes Dev*, vol. 28, 2432-2443; Hale et al., 2009, Cell, vol. 139, 945-956; Peng et al., 2015, *Nucleic acids research*, vol. 43, 406-417) and provides significant advantages. In the *Staphylococcus epidermis* type III-A system, transcription across targets results in cleavage of the target DNA and its transcripts, mediated by independent active sites within the Cas10-Csm ribonucleoprotein effector protein complex (see, Samai et al., 2015, Cell, vol. 151, 1164-1174). A CRISPR-Cas system, composition or method targeting RNA via the present effector proteins is thus provided.

In an embodiment, the Cas protein may be a C2c2 ortholog of an organism of a genus which includes but is not limited to Leptotrichia, *Listeria*, Corynebacter, Sutterella, *Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*. Species of organism of such a genus can be as otherwise herein discussed.

Some methods of identifying orthologues of CRISPR-Cas system enzymes may involve identifying tracr sequences in genomes of interest. Identification of tracr sequences may relate to the following steps: Search for the direct repeats or tracr mate sequences in a database to identify a CRISPR region comprising a CRISPR enzyme. Search for homologous sequences in the CRISPR region flanking the CRISPR enzyme in both the sense and antisense directions. Look for transcriptional terminators and secondary structures. Identify any sequence that is not a direct repeat or a tracr mate sequence but has more than 50% identity to the direct repeat or tracr mate sequence as a potential tracr sequence. Take the potential tracr sequence and analyze for transcriptional terminator sequences associated therewith.

It will be appreciated that any of the functionalities described herein may be engineered into CRISPR enzymes from other orthologs, including chimeric enzymes comprising fragments from multiple orthologs. Examples of such orthologs are described elsewhere herein. Thus, chimeric enzymes may comprise fragments of CRISPR enzyme orthologs of an organism which includes but is not limited to Leptotrichia, *Listeria*, Corynebacter, Sutterella, *Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*. A chimeric enzyme can comprise a first fragment and a second fragment, and the fragments can be of CRISPR enzyme orthologs of organisms of genera herein mentioned or of species herein mentioned; advantageously the fragments are from CRISPR enzyme orthologs of different species.

In embodiments, the C2c2 protein as referred to herein also encompasses a functional variant of C2c2 or a homologue or an orthologue thereof. A "functional variant" of a protein as used herein refers to a variant of such protein which retains at least partially the activity of that protein. Functional variants may include mutants (which may be insertion, deletion, or replacement mutants), including polymorphs, etc. Also included within functional variants are fusion products of such protein with another, usually unrelated, nucleic acid, protein, polypeptide or peptide. Functional variants may be naturally occurring or may be man-made. Advantageous embodiments can involve engineered or non-naturally occurring Type VI RNA-targeting effector protein.

In an embodiment, nucleic acid molecule(s) encoding the C2c2 or an ortholog or homolog thereof, may be codon-optimized for expression in a eukaryotic cell. A eukaryote can be as herein discussed. Nucleic acid molecule(s) can be engineered or non-naturally occurring.

In an embodiment, the C2c2 or an ortholog or homolog thereof, may comprise one or more mutations (and hence nucleic acid molecule(s) coding for same may have mutation(s). The mutations may be artificially introduced mutations and may include but are not limited to one or more mutations in a catalytic domain. Examples of catalytic domains with reference to a Cas9 enzyme may include but are not limited to RuvC I, RuvC II, RuvC III and HNH domains.

In an embodiment, the C2c2 or an ortholog or homolog thereof, may comprise one or more mutations. The mutations may be artificially introduced mutations and may include but are not limited to one or more mutations in a catalytic domain. Examples of catalytic domains with reference to a Cas enzyme may include but are not limited to HEPN domains.

In an embodiment, the C2c2 or an ortholog or homolog thereof, may be used as a generic nucleic acid binding protein with fusion to or being operably linked to a functional domain. Exemplary functional domains may include but are not limited to translational initiator, translational activator, translational repressor, nucleases, in particular ribonucleases, a spliceosome, beads, a light inducible/controllable domain or a chemically inducible/controllable domain.

In certain example embodiments, the C2c2 effector protein may be from an organism selected from the group consisting of; Leptotrichia, *Listeria, Corynebacter, Sutterella, Legionella, Treponema, Filifactor, Eubacterium,*

Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma, and Campylobacter.

In certain embodiments, the effector protein may be a Listeria sp. C2c2p, preferably Listeria seeligeri C2c2p, more preferably Listeria seeligeri serovar 1/2b str. SLCC3954 C2c2p and the crRNA sequence may be 44 to 47 nucleotides in length, with a 5' 29-nt direct repeat (DR) and a 15-nt to 18-nt spacer.

In certain embodiments, the effector protein may be a Leptotrichia sp. C2c2p, preferably Leptotrichia shahii C2c2p, more preferably Leptotrichia shahii DSM 19757 C2c2p and the crRNA sequence may be 42 to 58 nucleotides in length, with a 5' direct repeat of at least 24 nt, such as a 5' 24-28-nt direct repeat (DR) and a spacer of at least 14 nt, such as a 14-nt to 28-nt spacer, or a spacer of at least 18 nt, such as 19, 20, 21, 22, or more nt, such as 18-28, 19-28, 20-28, 21-28, or 22-28 nt.

In certain example embodiments, the effector protein may be a Leptotrichia sp., Leptotrichia wadei F0279, or a Listeria sp., preferably Listeria newyorkensis FSL M6-0635.

In certain example embodiments, the C2c2 effector proteins of the invention include, without limitation, the following 21 ortholog species (including multiple CRISPR loci: Leptotrichia shahii; Leptotrichia wadei (Lw2); Listeria seeligeri; Lachnospiraceae bacterium MA2020; Lachnospiraceae bacterium NK4A179; [Clostridium] aminophilum DSM 10710; Carnobacterium gallinarum DSM 4847; Carnobacterium gallinarum DSM 4847 (second CRISPR Loci); Paludibacter propionicigenes WB4; Listeria weihenstephanensis FSL R9-0317; Listeriaceae bacterium FSL M6-0635; Leptotrichia wadei F0279; Rhodobacter capsulatus SB 1003; Rhodobacter capsulatus R121; Rhodobacter capsulatus DE442; Leptotrichia buccalis C-1013-b; Herbinix hemicellulosilytica; [Eubacterium] rectale; Eubacteriaceae bacterium CHKCI004; Blautia sp. Marseille-P2398; and Leptotrichia sp. oral taxon 879 str.F0557. Twelve (12) further non-limiting examples are: Lachnospiraceae bacterium NK4A144; Chloroflexus aggregans; Demequina aurantiaca; Thalassospira sp. TSL5-1; Pseudobutyrivibrio sp. OR37; Butyrivibrio sp. YAB3001; Blautia sp. Marseille-P2398; Leptotrichia sp. Marseille-P3007; Bacteroides ihuae; Porphyromonadaceae bacterium KH3CP3RA; Listeria riparia; and Insolitispirillum peregrinum.

In certain embodiments, the C2c2 protein according to the invention is or is derived from one of the orthologues as described in the table below, or is a chimeric protein of two or more of the orthologues as described in the table below, or is a mutant or variant of one of the orthologues as described in the table below (or a chimeric mutant or variant), including dead C2c2, split C2c2, destabilized C2c2, etc. as defined herein elsewhere, with or without fusion with a heterologous/functional domain.

In certain example embodiments, the C2c2 effector protein is selected from Table 1 below.

TABLE 1

| C2c2 orthologue | Code | Multi Letter |
|---|---|---|
| Leptotrichia shahii | C2-2 | Lsh |
| L. wadei F0279 (Lw2) | C2-3 | Lw2 |
| Listeria seeligeri | C2-4 | Lse |
| Lachnospiraceae bacterium MA2020 | C2-5 | LbM |
| Lachnospiraceae bacterium NK4A179 | C2-6 | LbNK179 |
| Clostridium aminophilum DSM 10710 | C2-7 | Ca |
| Carnobacterium gallinarum DSM 4847 | C2-8 | Cg |
| Carnobacterium gallinarum DSM 4847 | C2-9 | Cg2 |
| Paludibacter propionicigenes WB4 | C2-10 | Pp |
| Listeria weihenstephanensis FSL R9-0317 | C2-11 | Lwei |
| Listeriaceae bacterium FSL M6-0635 | C2-12 | LbFSL |
| Leptotrichia wadei F0279 | C2-13 | Lw |
| Rhodobacter capsulatus SB 1003 | C2-14 | Rc |
| Rhodobacter capsulatus R121 | C2-15 | Rc |
| Rhodobacter capsulatus DE442 | C2-16 | Rc |
| Leptotrichia buccalis C-1013-b | C2-17 | LbuC2c2 |
| Herbinix hemicellulosilytics | C2-18 | HheC2c2 |
| Eubacterium rectale | C2-19 | EreC2c2 |
| Eubacteriaceae bacterium CHKC1004 | C2-20 | EbaC2c2 |
| Blautia sp. Marseille-P2398 | C2-21 | BsmC2c2 |
| Leptotrichia sp. oral taxon 879 str. F0557 | C2-22 | LspC2c2 |
| Lachnospiraceae bacterium NK4a144 | | |
| Chloroflexus aggregans | | |
| Demequina aurantiaca | | |
| Thalassospira sp. TSL5-1 | | |
| Pseudobutyrivibrio sp. OR37 | | |
| Butyrivibrio sp. YAB3001 | | |
| Blautia sp. Marseille-P2398 | | |
| Leptotrichia sp. Marseille-P300 | | |
| Bacteroides ihuae | | |
| Porphyromonadaceae bacterium KH3CP3RA | | |
| Listeria riparia | | |
| Insolitispirillum peregrinum | | |

The wild type protein sequences of the above species are listed in the Table 2 below. In certain embodiments, a nucleic acid sequence encoding the C2c2 protein is provided.

TABLE 2

| | |
|---|---|
| C2c2-2 | L. shahii (SEQ. ID. No. 1) (Lsh) (SEQ. I.D. No. 1) |
| C2c2-2 | L. shahii (SEQ. ID. No. 477) (Lsh) (SEQ. ID. No. 1) (SEQ. I.D. No. 477) WP_018451595.1 |
| c2c2-3 | L. wadei (Lw2) (SEQ. I.D. No. 2) |
| c2c2-4 | Listeria seeligeri (SEQ. I.D. No. 3) |
| c2c2-5 | 1 Lachnospiraceae bacterium MA2020 (SEQ. I.D. No. 4) |
| c2c2-6 | 2 Lachnospiraceae bacterium NK4A179 (SEQ. I.D. No. 5) |
| c2c2-7 | 3 Clostridium aminophilum DSM 10710 (SEQ. ID. No 6)(SEQ. I.D. No. 6) |
| c2c2-8 | 5 Carnobacterium gallinarum DSM 4847 (SEQ. ID. No 7) (SEQ. I.D. No. 7) |
| c2c2-9 | 6 Carnobacterium gallinarum DSM 4847 (SEQ. I.D. No. 8) |
| c2c2-10 | 7 Paludibacter propionicigenes WB4 (SEQ. I.D. No. 9) |
| c2c2-11 | 9 Listeria weihenstephanensis FSL R9-0317 (SEQ. ID. No. 10) ( |
| c2c2-12 | 10 Listeriaceae bacterium FSL M6-0635 = Listeria newyorkensis FSL M6-0635 (SEQ. I.D. No. 11) |

TABLE 2-continued

| | |
|---|---|
| c2c2-13 | 12 *Leptotrichia wadei* F0279 (SEQ. I.D. No. 12) |
| c2c2-14 | 15 *Rhodobacter capsulatus* SB 1003 (SEQ. I.D. No. 13) |
| c2c2-15 | 16 *Rhodobacter capsulatus* R121 (SEQ. I.D. No. 14) |
| c2c2-16 | 17 *Rhodobacter capsulatus* DE442 (SEQ. I.D. No. 15) |
| LbuC2c2 (C2-17) | *Leptorichia buccalis* C-1013-b (SEQ ID NO: 309) |
| HheC2c2 (C2-18) | *Herbinix hemicellulosilytica* (SEQ ID NO: 310) |
| EreC2c2 (C2-19) | *Eubacterium rectale* (SEQ ID NO: 311) |
| EbaC2C2 (C2-20) | Eubacteriaceae bacterium CHKCI004 (SEQ ID NO: 312) |
| C2c2 (C2-21) | *Blautia* sp. Marseille-P2398 (SEQ. I.D. No 319 |
| C2c2 (C2-22) | *Leptotrichia* sp. Oral taxon 879 str. F0557 (SEQ. I.D. No. 579) |
| C2c2 NK4A144 (C2-23) | Lachnospiraceae bacterium NK4A144 (SEQ. I.D. No. 313) |
| C2c2 Chloro_agg (C2-24) | RNA-binding protein S1 *Chloroflexus aggregans* (SEQ. I.D. No. 314) |
| C2c2 Dem_Aur (C2-25) | *Demequina aurantiaca* (SEQ. I.D. No. 315) |
| C2c2 Thal_Sp_TSL5 (C2-26) | *Thalassospira* sp. TSL5-1 (SEQ. I.D. No 316) |
| C2c2 Pseudo_sp (C2-27) | *Pseudobutyrivibrio* sp. OR37 (SEQ. I.D. No. 317) |
| C2c2_Buty_sp (C2-28) | *Butyrivibrio* sp. YAB3001 (SEQ. I.D. No. 318) |
| C2c2_Blautia_sp (C2-29) | *Blautia* sp. Marseille-P2398(SEQ. I.D. No. 478) |
| C2c2_Lepto_sp_Marseille (C2-30) | *Leptotrichia* sp. Marseille-P3007 (SEQ. ID No. 320) |
| C2c2_Bacteroides_ihuae (C2-31) | *Bacteroides ihuae* (SEQ. I.D. No 321) |
| C2c2_Porph_bacterium (C2-32) | Porphyromonadaceae bacterium KH3CP3RA (SEQ. I.D. No. 322) |
| C2c2_Listeria_riparia (C2-33) | *Listeria riparia* (SEQ. I.D. No. 323) |
| C2c2_insolitis_peregrinum (C2-34) | *Insolitispirillum peregrinum* (SEQ. I.D. No. 324) |

In an embodiment of the invention, there is provided effector protein which comprises an amino acid sequence having at least 80% sequence homology to the wild-type sequence of any of *Leptotrichia shahii* C2c2, Lachnospiraceae bacterium MA2020 C2c2, Lachnospiraceae bacterium NK4A179 C2c2, *Clostridium aminophilum* (DSM 10710) C2c2, *Carnobacterium gallinarum* (DSM 4847) C2c2, *Paludibacter propionicigenes* (WB4) C2c2, *Listeria weihenstephanensis* (FSL R9-0317) C2c2, Listeriaceae bacterium (FSL M6-0635) C2c2, *Listeria newyorkensis* (FSL M6-0635) C2c2, *Leptotrichia wadei* (F0279) C2c2, *Rhodobacter capsulatus* (SB 1003) C2c2, *Rhodobacter capsulatus* (R121) C2c2, *Rhodobacter capsulatus* (DE442) C2c2, *Leptotrichia wadei* (Lw2) C2c2, or *Listeria seeligeri* C2c2.

In an embodiment of the invention, the effector protein comprises an amino acid sequence having at least 80% sequence homology to a Type VI effector protein consensus sequence including but not limited to a consensus sequence described herein.

According to the invention, a consensus sequence can be generated from multiple C2c2 orthologs, which can assist in locating conserved amino acid residues, and motifs, including but not limited to catalytic residues and HEPN motifs in C2c2 orthologs that mediate C2c2 function. One such consensus sequence, generated from the 33 orthologs mentioned above using Geneious alignment is:

```
                                           (SEQ ID NO: 325)
MKISKVXXXVXKKXXXGKLXKXVNERNRXAKRLSNXLBKYIXXIDKIXK

KEXXXKKFXAXEEITLKLNQXXXBXLXKAXXDLRKDNXYSXJKKILHNED

INXEEXELLINDXLEKLXKIESXKYSYQKXXXNYXMSVQEHSKKSIXRI

XESAKRNKEALDKFLKEYAXLDPRMEXLAKLRKLLELYFYFKNDXIXXE

EEXNVXXHKXLKENHPDFVEXXXNKENAELNXYAIEXKKJLKYYFPXKX

AKNSNDKIFEKQELKKXWIHQJENAVERILLXXGKVXYKLQXGYLAELW

KIRINEIFIKYIXVGKAVAXFALRNXXKBENDILGGKIXKKLNGITSFX

YEKIKAEEILQREXAVEVAFAANXLYAXDLXXIRXSILQFFGGASNWDX

FLFFHFATSXISDKKWNAELIXXKKJGLVIREKLYSNNVAMFYSKDDLE

KLLNXLXXFXLRASQVPSFKKVYVRXBFPQNLLKKFNDEKDDEAYSAXY

YLLKEIYYNXFLPYFSANNXFFFXVKNLVLKANKDKFXXAFXDIREMNX

GSPIEYLXXTQXNXXNEGRKKEEKEXDFIKFLLQIFXKGFDDYLKNNXX

FILKFIPEPTEXIEIXXELQAWYIVGKFLNARKXNLLGXFXSYLKLLDD

IELRALRNENIKYQSSNXEKEVLEXCLELIGLLSLDLNDYFBDEXDFAX

YJGKXLDFEKKXMKDLAELXPYDQNDGENPIVNRNIXLAKKYGTLNLLE

KJXDKVSEKEIKEYYELKKEIEEYXXKGEELHEEWXQXKNRVEXRDILE

YXEELXGQIINYNXLXNKVLLYFQLGLHYLLLDILGRLVGYTGIWERDA

XLYQIAAMYXNGLPEYIXXKKNDKYKDGQIVGXKINXFKXDKKXLYNAG

LELFENXNEHKNIXIRNYIAHFNYLSKAESSLLXYSENLRXLFSYDRKL

KNAVXKSLINILLRHGMVLKFKFGTDKKSVXIRSXKKIXHLKSIAKKLY

YPEVXVSKEYCKLVKXLLKYK
```

In another non-limiting example, a sequence alignment tool to assist generation of a consensus sequence and identification of conserved residues is the MUSCLE alignment tool (www.ebi.ac.uk/Tools/msa/muscle/). For example, using MUSCLE, the following amino acid locations conserved among C2c2 orthologs can be identified in *Leptotrichia wadei* C2c2:K2; K5; V6; E301; L331; 1335; N341;

G351; K352; E375; L392; L396; D403; F446; I466; I470; R474 (HEPN); H475; H479 (HEPN), E508; P556; L561; I595; Y596; F600; Y669; I673; F681; L685; Y761; L676; L779; Y782; L836; D847; Y863; L869; I872; K879; I933; L954; I958; R961; Y965; E970; R971; D972; R1046 (HEPN), H1051 (HEPN), Y1075; D1076; K1078; K1080; I1083; I1090.

An exemplary sequence alignment of HEPN domains showing highly conserved residues is shown in FIG. 50.

In certain example embodiments, the RNA-targeting effector protein is a Type VI-B effector protein, such as Cas13b and Group 29 or Group 30 proteins. In certain example embodiments, the RNA-targeting effector protein comprises one or more HEPN domains. In certain example embodiments, the RNA-targeting effector protein comprises a C-terminal HEPN domain, a N-terminal HEPN domain, or both. Regarding example Type VI-B effector proteins that may be used in the context of this invention, reference is made to U.S. application Ser. No. 15/331,792 entitled "Novel CRISPR Enzymes and Systems" and filed Oct. 21, 2016, International Patent Application No. PCT/US2016/058302 entitled "Novel CRISPR Enzymes and Systems", and filed Oct. 21, 2016, and Smargon et al. "Cas13b is a Type VI-B CRISPR-associated RNA-Guided RNase differentially regulated by accessory proteins Csx27 and Csx28" Molecular Cell, 65, 1-13 (2017); dx.doi.org/10.1016/j.molcel.2016.12.023, and U.S. Provisional Application No. to be assigned, entitled "Novel Cas13b Orthologues CRISPR Enzymes and System" filed Mar. 15, 2017. In particular embodiments, the Cas13b enzyme is derived from *Bergeyella zoohelcum*. In certain other example embodiments, the effector protein is, or comprises an amino acid sequence having at least 80% sequence homology to any of the sequences listed in Table 3.

TABLE 3

| B-01 | *Bergeyella zoohelcum* |
| B-02 | *Prevotella intermedia* |
| B-03 | *Prevotella buccae* |
| B-04 | *Alistipes* sp. ZOR0009 |
| B-05 | *Prevotella* sp. MA2016 |
| B-06 | *Riemerella anatipestifer* |
| B-07 | *Prevotella aurantiaca* |
| B-08 | *Prevotella saccharolytica* |
| B-09 | *Prevotella intermedia* |
| B-10 | *Capnocytophaga canimorsus* |
| B-11 | *Porphyromonas gulae* |
| B-12 | *Prevotella* sp. P5-125 |
| B-13 | *Flavobacterium branchiophilum* |
| B-14 | *Porphyromonas gingivalis* |
| B-15 | *Prevotella intermedia* |

In certain example embodiments, the wild type sequence of the Cas13b orthologue is found in Table 4a or 4b below.

TABLE 4a

| *Bergeyella zoohelcum* (SEQ. I.D. No. 326) | 1 |
| *Prevotella intermedia* (SEQ. I.D. No. 327) | 2 |
| *Prevotella buccae* (SEQ. I.D. No. 328) | 3 |
| *Porphyromonas gingivalis* (SEQ. I.D. No. 329) | 4 |
| *Bacteroides pyogenes* (SEQ. I.D. No. 330) | 5 |
| *Alistipes* sp. ZOR0009 (SEQ. I.D. No. 331) | 6 |
| *Prevotella* sp. MA2016 (SEQ. I.D. No. 332) | 7a |
| *Prevotella* sp. MA2016 (SEQ. I.D. No. 333) | 7b |
| *Riemerella anatipestifer* (SEQ. I.D. No. 334) | 8 |
| *Prevotella aurantiaca* (SEQ. I.D. No. 335) | 9 |
| *Prevotella saccharolytica* (SEQ. I.D. No. 336) | 10 |
| HMPREF9712_03108 [*Myroides odoratimimus* CCUG 10230] (SEQ. I.D. No. 337) | 11 |
| *Prevotella intermedia* (SEQ. I.D. No. 338) | 12 |
| *Capnocytophaga canimorsus* (SEQ. I.D. No. 339) | 13 |
| *Porphyromonas gulae* (SEQ. I.D. No. 340) | 14 |
| *Prevotella* sp. P5-125 (SEQ. I.D. No. 341) | 15 |
| *Flavobacterium branchiophilum* (SEQ. I.D. No. 342) | 16 |
| *Myroides odoratimimus* (SEQ. I.D. No. 343) | 17 |
| *Flavobacterium columnare* (SEQ. I.D. No. 344) | 18 |
| *Porphyromonas gingivalis* (SEQ. I.D. No. 345) | 19 |
| *Porphyromonas* sp. COT-052 OH4946 (SEQ. I.D. No. 346) | 20 |
| *Prevotella intermedia* (SEQ. I.D. No. 347) | 21 |
| PIN17_0200 [*Prevotella intermedia* 17] (SEQ. I.D. No. 348) | AFJ07523 |
| *Prevotella intermedia* (SEQ. I.D. No. 349) | BAU18623 |
| HMPREF6485_0083 [*Prevotella buccae* ATCC 33574] (SEQ. I.D. No. 350) | EFU31981 |
| HMPREF9144_1146 [*Prevotella pallens* ATCC 700821] (SEQ. I.D. No. 351) | EGQ18444 |
| HMPREF9714_02132 [*Myroides odoratimimus* CCUG 12901] (SEQ. I.D. No. 352) | EHO08761 |
| HMPREF9711_00870 [*Myroides odoratimimus* CCUG 3837] (SEQ. I.D. No. 353) | EKB06014 |
| HMPREF9699_02005 [*Bergeyella zoohelcum* ATCC 43767] (SEQ. I.D. No. 354) | EKB54193 |
| HMPREF9151_01387 [*Prevotella saccharolytica* F0055] (SEQ. I.D. No. 355) | EKY00089 |
| A343_1752 [*Porphyromonas gingivalis* JCVI SC001] (SEQ. I.D. No. 356) | EOA10535 |
| HMPREF1981_03090 [*Bacteroides pyogenes* F0041] (SEQ. I.D. No. 357) | ERI81700 |
| HMPREF1553_02065 [*Porphyromonas gingivalis* F0568] (SEQ. I.D. No. 358) | ERJ65637 |
| HMPREF1988_01768 [*Porphyromonas gingivalis* F0185] (SEQ. I.D. No. 359) | ERJ81987 |
| HMPREF1990_01800 [*Porphyromonas gingivalis* W4087] (SEQ. I.D. No. 360) | ERJ87335 |
| M573_117042 [*Prevotella intermedia* ZT] (SEQ. I.D. No. 361) | KJJ86756 |
| A2033_10205 [*Bacteroidetes bacterium* GWA2_31_9] (SEQ. I.D. No. 362) | OFX18020.1 |
| SAMN05421542_0666 [*Chryseobacterium jejuense*] (SEQ. I.D. No. 363) | SDI27289.1 |
| SAMN05444360_11366 [*Chryseobacterium carnipullorum*] (SEQ. I.D. No. 364) | SHM52812.1 |
| SAMN05421786_1011119 [*Chryseobacterium ureilyticum*] (SEQ. I.D. No. 365) | SIS70481.1 |
| *Prevotella buccae* (SEQ. I.D. No. 366) | WP_004343581 |
| *Porphyromonas gingivalis* (SEQ. I.D. No. 367) | WP_005873511 |
| *Porphyromonas gingivalis* (SEQ. I.D. No. 368) | WP_005874195 |
| *Prevotella pallens* (SEQ. I.D. No. 369) | WP_006044833 |
| *Myroides odoratimimus* (SEQ. I.D. No. 370) | WP_006261414 |
| *Myroides odoratimimus* (SEQ. I.D. No. 371) | WP_006265509 |

TABLE 4a-continued

| | |
|---|---|
| *Prevotella* sp. MSX73 (SEQ. I.D. No. 372) | WP_007412163 |
| *Porphyromonas gingivalis* (SEQ. I.D. No. 373) | WP_012458414 |
| *Paludibacter propionicigenes* (SEQ. I.D. No. 374) | WP_013446107 |
| *Porphyromonas gingivalis* (SEQ. I.D. No. 375) | WP_013816155 |
| *Flavobacterium columnare* (SEQ. I.D. No. 376) | WP_014165541 |
| *Psychroflexus torquis* (SEQ. I.D. No. 377) | WP_015024765 |
| *Riemerella anatipestifer* (SEQ. I.D. No. 378) | WP_015345620 |
| *Prevotella pleuritidis* (SEQ. I.D. No. 379) | WP_021584635 |
| *Porphyromonas gingivalis* (SEQ. I.D. No. 380) | WP_021663197 |
| *Porphyromonas gingivalis* (SEQ. I.D. No. 381) | WP_021665475 |
| *Porphyromonas gingivalis* (SEQ. I.D. No. 382) | WP_021677657 |
| *Porphyromonas gingivalis* (SEQ. I.D. No. 383) | WP_021680012 |
| *Porphyromonas gingivalis* (SEQ. I.D. No. 384) | WP_023846767 |
| *Prevotella falsenii* (SEQ. I.D. No. 385) | WP_036884929 |
| *Prevotella pleuritidis* (SEQ. I.D. No. 386) | WP_036931485 |
| [*Porphyromonas gingivalis* (SEQ. I.D. No. 387) | WP_039417390 |
| *Porphyromonas gulae* (SEQ. I.D. No. 388) | WP_039418912 |
| *Porphyromonas gulae* (SEQ. I.D. No. 389) | WP_039419792 |
| *Porphyromonas gulae* (SEQ. I.D. No. 390) | WP_039426176 |
| *Porphyromonas gulae* (SEQ. I.D. No. 391) | WP_039431778 |
| *Porphyromonas gulae* (SEQ. I.D. No. 392) | WP_039437199 |
| *Porphyromonas gulae* (SEQ. I.D. No. 393) | WP_039442171 |
| *Porphyromonas gulae* (SEQ. I.D. No. 394) | WP_039445055 |
| *Capnocytophaga cynodegmi* (SEQ. I.D. No. 395) | WP_041989581 |
| *Prevotella* sp. P5-119 (SEQ. I.D. No. 396) | WP_042518169 |
| *Prevotella* sp. P4-76 (SEQ. I.D. No. 397) | WP_044072147 |
| *Prevotella* sp. P5-60 (SEQ. I.D. No. 398) | WP_044074780 |
| *Phaeodactylibacter xiamenensis* (SEQ. I.D. No. 399) | WP_044218239 |
| *Flavobacterium* sp. 316 (SEQ. I.D. No. 400) | WP_045968377 |
| *Porphyromonas gulae* (SEQ. I.D. No. 401) | WP_046201018 |
| WP_047431796 (SEQ. I.D. No. 402) | *Chryseobacterium* sp. YR477 |
| *Riemerella anatipestifer* (SEQ. I.D. No. 403) | WP_049354263 |
| *Porphyromonas gingivalis* (SEQ. I.D. No. 404) | WP_052912312 |
| *Porphyromonas gingivalis* (SEQ. I.D. No. 405) | WP_058019250 |
| *Flavobacterium columnare* (SEQ. I.D. No. 406) | WP_060381855 |
| *Porphyromonas gingivalis* (SEQ. I.D. No. 407) | WP_061156470 |
| *Porphyromonas gingivalis* (SEQ. I.D. No. 408) | WP_061156637 |
| *Riemerella anatipestifer* (SEQ. I.D. No. 409) | WP_061710138 |
| *Flavobacterium columnare* (SEQ. I.D. No. 410) | WP_063744070 |
| *Riemerella anatipestifer* (SEQ. I.D. No. 411) | WP_064970887 |
| *Sinomicrobium oceani* (SEQ. I.D. No. 412) | WP_072319476.1 |
| *Reichenbachiella agariperforans* (SEQ. I.D. No. 413) | WP_073124441.1 |

TABLE 4b

| Name or Accession No. |
|---|
| WP_015345620 (SEQ. I.D. No. 479) |
| WP_049354263 (SEQ. I.D. No. 480) |
| WP_061710138 (SEQ. I.D. No. 481) |
| 6 (SEQ. I.D. No. 482) *Alistipes* sp. ZOR0009 |
| SIS70481.1 (SEQ. ID. No 483) |
| 15 *Prevotella* sp. (SEQ. I.D. No. 484) |
| WP_042518169 (SEQ. I.D. No. 485) |
| WP_044072147 (SEQ. I.D. No. 486) |
| WP_044074780 (SEQ. I.D. No. 487) |
| 8_(modified) (SEQ. I.D. No. 488) |
| WP_064970887 (SEQ. I.D. No. 489) |
| 5 (SEQ. I.D. No. 490) |
| ERI81700 (SEQ. I.D. No. 491) |
| WP_036931485 (SEQ. I.D. No. 492) |
| 19 (SEQ. I.D. No. 493) |
| WP_012458414 (SEQ. I.D. No. 494) |
| WP_013816155 (SEQ. I.D. No. 495) |
| WP_039417390 (SEQ. I.D. No. 496) |
| WP_039419792 (SEQ. I.D. No. 497) |
| WP_039426176 (SEQ. I.D. No. 498) |
| WP_039437199 (SEQ. I.D. No. 499) |
| WP_061156470 (SEQ. I.D. No. 500) |
| 12 (SEQ. I.D. No. 501) |
| 9 (SEQ. I.D. No. 502) |
| EGQ18444 (SEQ. I.D. No. 503) |
| KJJ86756 (SEQ. I.D. No. 504) |
| WP_006044833 (SEQ. I.D. No. 505) |
| 2 (SEQ. I.D. No. 506) |
| 3 (SEQ. I.D. No. 507) |
| EFU31981 (SEQ. I.D. No. 508) |
| WP_004343581 (SEQ. I.D. No. 509) |
| WP_007412163 (SEQ. I.D. No. 510) |
| WP_044218239 (SEQ. I.D. No. 511) |
| 21 (SEQ. I.D. No. 512) |
| BAU18623 (SEQ. I.D. No. 513) |
| WP_036884929 (SEQ. I.D. No. 514) |
| WP_073124441.1 (SEQ. I.D. No. 515) |
| AFJ07523 (SEQ. I.D. No. 516) |
| 4 (SEQ. I.D. No. 517) |
| ERJ65637 (SEQ. I.D. No. 518) |
| ERJ81987 (SEQ. I.D. No. 519) |
| ERJ87335 (SEQ. I.D. No. 520) |
| WP_005873511 (SEQ. I.D. No. 521) |
| WP_021663197 (SEQ. I.D. No. 522) |
| WP_021665475 (SEQ. I.D. No. 523) |
| WP_021677657 (SEQ. I.D. No. 524) |
| WP_021680012 (SEQ. I.D. No. 525) |
| WP_023846767 (SEQ. I.D. No. 526) |
| WP_039445055 (SEQ. I.D. No. 527) |
| WP_061156637 (SEQ. I.D. No. 528) |
| WP_021584635 (SEQ. I.D. No. 529) |
| WP_015024765 (SEQ. I.D. No. 530) |
| WP_047431796 (SEQ. I.D. No. 531) |
| WP_072319476.1 (SEQ. I.D. No. 532) |
| 16 (SEQ. I.D. No. 533) |
| EKY00089 (SEQ. I.D. No. 534) |
| 10 (SEQ. I.D. No. 535) |
| WP_013446107 (SEQ. I.D. No. 536) |

TABLE 4b-continued

Name or Accession No.

WP_045968377 (SEQ. I.D. No. 537)
SHM52812.1 (SEQ. I.D. No. 538)
EHO08761 (SEQ. I.D. No. 539)
EKB06014 (SEQ. I.D. No. 540)
WP_006261414 (SEQ. I.D. No. 541)
WP_006265509 (SEQ. I.D. No. 542)
11 (SEQ. I.D. No. 543)
17 (SEQ. I.D. No. 544)
OFX18020.1 (SEQ. I.D. No. 545)
SDI27289.1 (SEQ. I.D. No. 546)
WP_039442171 (SEQ. I.D. No. 547)
14 (SEQ. I.D. No. 548)
20 (SEQ. I.D. No. 549)
EOA10535 (SEQ. I.D. No. 550)
WP_005874195 (SEQ. I.D. No. 551)
WP_039418912 (SEQ. I.D. No. 552)
WP_039431778 (SEQ. I.D. No. 553)
WP_046201018 (SEQ. I.D. No. 554)
WP_052912312 (SEQ. I.D. No. 555)
WP_058019250 (SEQ. I.D. No. 556)
WP_014165541 (SEQ. I.D. No. 557)
13 (SEQ. I.D. No. 558)
WP_060381855 (SEQ. I.D. No. 559)
WP_063744070 (SEQ. I.D. No. 560)
18 (SEQ. I.D. No. 561)
WP_041989581 (SEQ. I.D. No. 562)
1 (SEQ. I.D. No. 563)
EKB54193 (SEQ. I.D. No. 564)
7_(modified) (SEQ. I.D. No. 565)
7_(modified)_-_residues_only (SEQ. I.D. No. 566)

In certain example embodiments, the RNA-targeting effector protein is a Cas13c effector protein as disclosed in U.S. Provisional Patent Application No. 62/525,165 filed Jun. 26, 2017, and PCT Application No. US 2017/047193 filed Aug. 16, 2017. Example wildtype orthologue sequences of Cas13c are provided in Table 5 below.

TABLE 5

Name

EHO19081 (SEQ. I.D. No. 567)
WP_094899336 (SEQ. I.D. No. 568)
WP_040490876 (SEQ. I.D. No. 569)
WP_047396607 (SEQ. I.D. No. 570)
WP_035935671 (SEQ. I.D. No. 571)
WP_035906563 (SEQ. I.D. No. 572)
WP_042678931 (SEQ. I.D. No. 573)
WP_062627846 (SEQ. I.D. No. 574)
WP_005959231 (SEQ. I.D. No. 575)
WP_027128616 (SEQ. I.D. N. 576)
WP_062624740 (SEQ. I.D. No. 577)
WP_096402050 (SEQ. I.D. No. 578)

In certain example embodiments, the Cas13 protein may be selected from any of the following.

TABLE 6

| ID | Species | Seq. ID. No: |
|---|---|---|
| Cas13a1 | *Leptotrichia shahii* | 580 |
| Cas13a2 | *Leptotrichia wadei* (Lw2) | 581 |
| Cas13a3 | *Listeria seeligeri* | 582 |
| Cas13a4 | Lachnospiraceae bacterium MA2020 | 583 |
| Cas13a5 | Lachnospiraceae bacterium NK4A179 | 584 |
| Cas13a6 | [*Clostridium*] *aminophilum* DSM 10710 | 585 |
| Cas13a7 | *Carnobacterium gallinarum* DSM 4847 | 586 |
| Cas13a8 | *Carnobacterium gallinarum* DSM 4847 | 587 |
| Cas13a9 | *Paludibacter propionicigenes* WB4 | 588 |
| Cas13a10 | *Listeria weihenstephanensis* FSL R9-0317 | 589 |
| Cas13a11 | Listeriaceae bacterium FSL M6-0635 | 590 |

TABLE 6-continued

| ID | Species | Seq. ID. No: |
|---|---|---|
| Cas13a12 | *Leptotrichia wadei* F0279 | 591 |
| Cas13a13 | *Rhodobacter capsulatus* SB 1003 | 592 |
| Cas13a14 | *Rhodobacter capsulatus* R121 | 593 |
| Cas13a15 | *Rhodobacter capsulatus* DE442 | 594 |
| Cas13a16 | *Leptotrichia buccalis* C-1013-b | 595 |
| Cas13a17 | *Herbinix hemicellulosilytica* | 596 |
| Cas13a18 | [*Eubacterium*] *rectale* | 597 |
| Cas13a19 | Eubacteriaceae bacterium CHKCI004 | 598 |
| Cas13a20 | *Blautia* sp. Marseille-P2398 | 599 |
| Cas13a21 | *Leptotrichia* sp. oral taxon 879 str. F0557 | 600 |
| Cas13b1 | *Bergeyella zoohelcum* | 601 |
| Cas13b2 | *Prevotella intermedia* | 602 |
| Cas13b3 | *Prevotella buccae* | 603 |
| Cas13b4 | *Alistipes* sp. ZOR0009 | 604 |
| Cas13b5 | *Prevotella* sp. MA2016 | 605 |
| Cas13b6 | *Riemerella anatipestifer* | 606 |
| Cas13b7 | *Prevotella aurantiaca* | 607 |
| Cas13b8 | *Prevotella saccharolytica* | 608 |
| Cas13b9 | *Prevotella intermedia* | 609 |
| Cas13b10 | *Capnocytophaga canimorsus* | 610 |
| Cas13b11 | *Porphyromonas gulae* | 611 |
| Cas13b12 | *Prevotella* sp. P5-125 | 612 |
| Cas13b13 | *Flavobacterium branchiophilum* | 613 |
| Cas13b14 | *Porphyromonas gingivalis* | 614 |
| Cas13b15 | *Prevotella intermedia* | 615 |
| Cas13c1 | *Fusobacterium necrophorum* subsp. *funduliforme* ATCC 51357 contig00003 | 616 |
| Cas13c2 | *Fusobacterium necrophorum* DJ-2 contig0065, whole genome shotgun sequence | 617 |
| Cas13c3 | *Fusobacterium necrophorum* BFTR-1 contig0068 | 618 |
| Ca13c4 | *Fusobacterium necrophorum* subsp. *funduliforme* 1_1_36S cont1.14 | 619 |
| Cas13c5 | *Fusobacterium perfoetens* ATCC 29250 T364DRAFT_scaffold00009.9_C | 620 |
| Cas13c6 | *Fusobacterium ulcerans* ATCC 49185 cont2.38 | 621 |
| Cas13c7 | *Anaerosalibacter* sp. ND1 genome assembly *Anaerosalibacter massiliensis* ND1 | 622 |

In some embodiments, one or more elements of a nucleic acid-targeting system is derived from a particular organism comprising an endogenous CRISPR RNA-targeting system. In certain embodiments, the CRISPR RNA-targeting system is found in *Eubacterium* and *Ruminococcus*. In certain embodiments, the effector protein comprises targeted and collateral ssRNA cleavage activity. In certain embodiments, the effector protein comprises dual HEPN domains. In certain embodiments, the effector protein lacks a counterpart to the Helical-1 domain of Cas13a. In certain embodiments, the effector protein is smaller than previously characterized class 2 CRISPR effectors, with a median size of 928 aa. This median size is 190 aa (17%) less than that of Cas13c, more than 200 aa (18%) less than that of Cas13b, and more than 300 aa (26%) less than that of Cas13a. In certain embodiments, the effector protein has no requirement for a flanking sequence (e.g., PFS, PAM).

In certain embodiments, the effector protein locus structures include a WYL domain containing accessory protein (so denoted after three amino acids that were conserved in the originally identified group of these domains; see, e.g., WYL domain IPR026881). In certain embodiments, the WYL domain accessory protein comprises at least one helix-turn-helix (HTH) or ribbon-helix-helix (RHH) DNA-binding domain. In certain embodiments, the WYL domain containing accessory protein increases both the targeted and the collateral ssRNA cleavage activity of the RNA-targeting effector protein. In certain embodiments, the WYL domain containing accessory protein comprises an N-terminal RHH domain, as well as a pattern of primarily hydrophobic conserved residues, including an invariant tyrosine-leucine doublet corresponding to the original WYL motif. In certain embodiments, the WYL domain containing accessory protein is WYL1. WYL1 is a single WYL-domain protein associated primarily with *Ruminococcus*.

In other example embodiments, the Type VI RNA-targeting Cas enzyme is Cas13d. In certain embodiments, Cas13d is *Eubacterium siraeum* DSM 15702 (EsCas13d) or *Ruminococcus* sp. N15.MGS-57 (RspCas13d) (see, e.g., Yan et al., Cas13d Is a Compact RNA-Targeting Type VI CRISPR Effector Positively Modulated by a WYL-Domain-Containing Accessory Protein, Molecular Cell (2018), doi.org/10.1016/j.molcel.2018.02.028). RspCas13d and EsCas13d have no flanking sequence requirements (e.g., PFS, PAM).

Guide Sequences

As used herein, the term "guide sequence," "crRNA," "guide RNA," or "single guide RNA," or "gRNA" refers to a polynucleotide comprising any polynucleotide sequence having sufficient complementarity with a target nucleic acid sequence to hybridize with the target nucleic acid sequence and to direct sequence-specific binding of a RNA-targeting complex comprising the guide sequence and a CRISPR effector protein to the target nucleic acid sequence. In some example embodiments, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), Clustal W, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence, and hence a nucleic acid-targeting guide may be selected to target any target nucleic acid sequence. The target sequence may be DNA. The target sequence may be any RNA sequence. In some embodiments, the target sequence may be a sequence within a RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non-coding RNA (ncRNA), long non-coding RNA (lncRNA), and small cytoplasmic RNA (scRNA). In some preferred embodiments, the target sequence may be a sequence within a RNA molecule selected from the group consisting of mRNA, pre-mRNA, and rRNA. In some preferred embodiments, the target sequence may be a sequence within a RNA molecule selected from the group consisting of ncRNA, and lncRNA. In some more preferred embodiments, the target sequence may be a sequence within an mRNA molecule or a pre-mRNA molecule.

In some embodiments, a nucleic acid-targeting guide is selected to reduce the degree secondary structure within the nucleic acid-targeting guide. In some embodiments, about or less than about 75%, 50%, 40%, 30%, 25%, 20%, 15%, 10%, 5%, 1%, or fewer of the nucleotides of the nucleic acid-targeting guide participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and PA Carr and GM Church, 2009, Nature Biotechnology 27(12): 1151-62).

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

In general, the CRISPR-Cas, CRISPR-Cas9 or CRISPR system may be as used in the foregoing documents, such as WO 2014/093622 (PCT/US2013/074667) and refers collectively to transcripts and other elements involved in the expression of or directing the activity of CRISPR-associated ("Cas") genes, including sequences encoding a Cas gene, in particular a Cas9 gene in the case of CRISPR-Cas9, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). In the context of formation of a CRISPR complex, "target sequence" refers to a sequence to which a guide sequence is designed to have complementarity, where hybridization between a target sequence and a guide sequence promotes the formation of a CRISPR complex. The section of the guide sequence through which complementarity to the target sequence is important for cleavage activity is referred to herein as the seed sequence. A target sequence may comprise any polynucleotide, such as DNA or RNA polynucleotides. In some embodiments, a target sequence is located in the nucleus or cytoplasm of a cell, and may include nucleic acids in or from mitochondrial, organelles, vesicles, liposomes or particles present within the cell. In some embodiments, especially for non-nuclear uses, NLSs are not preferred. In some embodiments, a CRISPR system comprises one or more nuclear exports signals (NESs). In some embodiments, a CRISPR system comprises one or more NLSs and one or more NESs. In some embodiments, direct repeats may be identified in silico by searching for repetitive motifs that fulfill any or all of the following criteria: 1. found in a 2 Kb window of genomic sequence flanking the type II CRISPR locus; 2. span from 20 to 50 bp; and 3. interspaced by 20 to 50 bp. In some embodiments, 2 of these criteria may be used, for instance 1 and 2, 2 and 3, or 1 and 3. In some embodiments, all 3 criteria may be used.

In embodiments of the invention the terms guide sequence and guide RNA, i.e. RNA capable of guiding Cas to a target genomic locus, are used interchangeably as in foregoing cited documents such as WO 2014/093622 (PCT/US2013/074667). In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), Clustal W, Clustal X, BLAT, Novoalign (Novocraft Technologies; available at www.novocraft.com), ELAND (Illumina, San Diego, Calif.), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10 to 30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

In some embodiments of CRISPR-Cas systems, the degree of complementarity between a guide sequence and its corresponding target sequence can be about or more than about 50%, 60%, 75%, 80%, 85%, 90%, 95%, 97.5%, 99%, or 100%; a guide or RNA or sgRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide or RNA or sgRNA can be less than about 75, 50, 45, 40, 35, 30, 25, 20, 15, 12, or fewer nucleotides in length; and advantageously tracrRNA is 30 or 50 nucleotides in length. However, an aspect of the invention is to reduce off-target interactions, e.g., reduce the guide interacting with a target sequence having low complementarity. Indeed, in the examples, it is shown that the invention involves mutations that result in the CRISPR-Cas system being able to distinguish between target and off-target sequences that have greater than 80% to about 95% complementarity, e.g., 83%-84% or 88-89% or 94-95% complementarity (for instance, distinguishing between a target having 18 nucleotides from an off-target of 18 nucleotides having 1, 2 or 3 mismatches). Accordingly, in the context of the present invention the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%, or 100%. Off target is less than 100% or 99.9% or 99.5% or 99% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the sequence and the guide, with it advantageous that off target is 100% or 99.9% or 99.5% or 99% or 99% or 98.5% or 98% or 97.5% or 97% or 96.5% or 96% or 95.5% or 95% or 94.5% complementarity between the sequence and the guide.

Guide Modifications

In certain embodiments, guides of the invention comprise non-naturally occurring nucleic acids and/or non-naturally occurring nucleotides and/or nucleotide analogs, and/or chemical modifications. Non-naturally occurring nucleic acids can include, for example, mixtures of naturally and non-naturally occurring nucleotides. Non-naturally occurring nucleotides and/or nucleotide analogs may be modified at the ribose, phosphate, and/or base moiety. In an embodiment of the invention, a guide nucleic acid comprises ribonucleotides and non-ribonucleotides. In one such embodiment, a guide comprises one or more ribonucleotides and one or more deoxyribonucleotides. In an embodiment of the invention, the guide comprises one or more non-naturally occurring nucleotide or nucleotide analog such as a nucleotide with phosphorothioate linkage, boranophosphate linkage, a locked nucleic acid (LNA) nucleotides comprising a methylene bridge between the 2' and 4' carbons of the ribose ring, or bridged nucleic acids (BNA). Other examples of modified nucleotides include 2'-O-methyl analogs, 2'-deoxy analogs, 2-thiouridine analogs, N6-methyladenosine analogs, or 2'-fluoro analogs. Further examples of modified bases include, but are not limited to, 2-aminopurine, 5-bromo-uridine, pseudouridine ($\Psi$), $N^1$-methylpseudouridine (me¹Ψ), 5-methoxyuridine(5moU), inosine, 7-methylguanosine. Examples of guide RNA chemical modifications include, without limitation, incorporation of 2'-O-methyl (M), 2'-O-methyl-3'-phosphorothioate (MS), phosphorothioate (PS), S-constrained ethyl(cEt), or 2'-O-methyl-3'-thioPACE (MSP) at one or more terminal nucleotides. Such chemically modified guides can comprise increased stability and increased activity as compared to unmodified guides, though on-target vs. off-target specificity is not predictable. (See, Hendel, 2015, Nat Biotechnol. 33(9):985-9, doi: 10.1038/nbt.3290, published online 29 Jun. 2015; Ragdarm et al., 0215, *PNAS*, E7110-E7111; Allerson et al., *J. Med. Chem.* 2005, 48:901-904; Bramsen et al., *Front. Genet.*, 2012, 3:154; Deng et al., *PNAS*, 2015, 112:11870-11875; Sharma et al., *Med Chem Comm.*, 2014, 5:1454-1471; Hendel et al., *Nat. Biotechnol.* (2015) 33(9): 985-989; Li et al., *Nature Biomedical Engineering*, 2017, 1, 0066 DOI: 10.1038/s41551-017-0066). In some embodiments, the 5' and/or 3' end of a guide RNA is modified by a variety of functional moieties including fluorescent dyes, polyethylene glycol, cholesterol, proteins, or detection tags. (See Kelly et al., 2016, *J. Biotech.* 233:74-83). In certain embodiments, a guide comprises ribonucleotides in a region that binds to a target DNA and one or more deoxyribonucleotides and/or nucleotide analogs in a region that binds to Cas9, Cpf1, or C2c1. In an embodiment of the invention, deoxyribonucleotides and/or nucleotide analogs are incorporated in engineered guide structures, such as, without limitation, 5' and/or 3' end, stem-loop regions, and the seed region. In certain embodiments, the modification is not in the 5'-handle of the stem-loop regions. Chemical modification in the 5'-handle of the stem-loop region of a guide may abolish its function (see Li, et al., *Nature Biomedical Engineering*, 2017, 1:0066). In certain embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, or 75 nucleotides of a guide is chemically modified. In some embodiments, 3-5 nucleotides at either the 3' or the 5' end of a guide is chemically modified. In some embodiments, only minor modifications are introduced in the seed region, such as 2'-F modifications. In some embodiments, 2'-F modification is introduced at the 3' end of a guide. In certain embodiments, three to five nucleotides at the 5' and/or the 3' end of the guide are chemically modified with 2'-O-methyl (M), 2'-O-methyl-3'-phosphorothioate (MS), S-constrained ethyl(cEt), or 2'-O-methyl-3'-thioPACE (MSP). Such modification can enhance genome editing efficiency (see Hendel et al., Nat. Biotechnol. (2015) 33(9): 985-989). In certain embodiments, all of the phosphodiester bonds of a guide are substituted with phosphorothioates (PS) for enhancing levels of gene disruption. In certain embodiments, more than five nucleotides at the 5' and/or the 3' end of the guide are chemically modified with 2'-O-Me, 2'-F or S-constrained ethyl(cEt). Such chemically modified guide can mediate enhanced levels of gene disruption (see Ragdarm et al., 0215, PNAS, E7110-E7111). In an embodiment of the invention, a guide is modified to comprise a chemical moiety at its 3' and/or 5' end. Such moieties include, but are not limited to amine, azide, alkyne, thio, dibenzocyclooctyne (DBCO), or Rhodamine. In certain embodiment, the chemical moiety is conjugated to the guide by a linker, such as an alkyl chain. In certain embodiments, the chemical moiety of the modified guide can be used to attach the guide to another molecule, such as DNA, RNA, protein, or nanoparticles. Such chemically modified guide can be used to identify or enrich cells generically edited by a CRISPR system (see Lee et al., *eLife*, 2017, 6:e25312, DOI:10.7554).

In certain embodiments, the CRISPR system as provided herein can make use of a crRNA or analogous polynucleotide comprising a guide sequence, wherein the polynucleotide is an RNA, a DNA or a mixture of RNA and DNA, and/or wherein the polynucleotide comprises one or more nucleotide analogs. The sequence can comprise any structure, including but not limited to a structure of a native crRNA, such as a bulge, a hairpin or a stem loop structure. In certain embodiments, the polynucleotide comprising the guide sequence forms a duplex with a second polynucleotide sequence which can be an RNA or a DNA sequence.

In certain embodiments, use is made of chemically modified guide RNAs. Examples of guide RNA chemical modifications include, without limitation, incorporation of 2'-O-methyl (M), 2'-O-methyl 3'phosphorothioate (MS), or 2'4i: 1-methyl 3'thioPACE (MSP) at one or more terminal nucleotides. Such chemically modified guide RNAs can comprise increased stability and increased activity as compared to unmodified guide RNAs, though on-target vs. off-target specificity is not predictable. (See, Hendel, 2015, Nat Biotechnol. 33(9):985-9, doi: 10.1038/nbt.3290, published online 29 Jun. 2015). Chemically modified guide RNAs further include, without limitation, RNAs with phosphorothioate linkages and locked nucleic acid (LNA) nucleotides comprising a methylene bridge between the 2' and 4' carbons of the ribose ring.

In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10 to 30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay. Similarly, cleavage of a target RNA may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

In some embodiments, the modification to the guide is a chemical modification, an insertion, a deletion or a split. In some embodiments, the chemical modification includes, but is not limited to, incorporation of 2¹-O-methyl (M) analogs, T-deoxy analogs, 2-thiouridine analogs, N6-methyladenosine analogs, 2'-fluoro analogs, 2-aminopurine, 5-bromo-uridine, pseudouridine (Ψ), N¹-methylpseudouridine (N1mΨ), 5-methoxyuridine(5moU), inosine, 7-methylguanosine, 2'-O-methyl-3'-phosphorothioate (MS), S-constrained ethyl(cEt), phosphorothioate (PS), or 2'-O-methyl-3'-thioPACE (MSP). In some embodiments, the guide comprises one or more of phosphorothioate modifications. In certain embodiments, at least 1, 2, 3, 4, 5, 6, 7, 8, 9, 10, 11, 12, 13, 14, 15, 16, 17, 18, 19, 20, or 25 nucleotides of the guide are chemically modified. In certain embodiments, one or more nucleotides in the seed region are chemically modified. In certain embodiments, one or more nucleotides in the 3'-terminus are chemically modified. In certain embodiments, none of the nucleotides in the 5'-handle is chemically modified. In some embodiments, the chemical modification in the seed region is a minor modification, such as incorporation of a 2'-fluoro analog. In a specific embodiment, one nucleotide of the seed region is replaced with a 2'-fluoro analog. In some embodiments, 5 or 10 nucleotides in the 3'-terminus are chemically modified. Such chemical modifications at the 3'-terminus of the Cpf1 CrRNA improve gene cutting efficiency (see Li, et al., Nature Biomedical Engineering, 2017, 1:0066). In a specific embodiment, 5 nucleotides in the 3'-terminus are replaced with 2'-fluoro analogues. In a specific embodiment, 10 nucleotides in the 3'-terminus are replaced with 2'-fluoro analogues. In a specific embodiment, 5 nucleotides in the 3'-terminus are replaced with 2'-O-methyl (M) analogs.

In some embodiments, the loop of the 5'-handle of the guide is modified. In some embodiments, the loop of the 5'-handle of the guide is modified to have a deletion, an insertion, a split, or chemical modifications. In certain embodiments, the loop comprises 3, 4, or 5 nucleotides. In certain embodiments, the loop comprises the sequence of UCUU, UUUU, UAUU, or UGUU.

A guide sequence, and hence a nucleic acid-targeting guide RNA may be selected to target any target nucleic acid sequence. In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to a RNA polynucleotide being or comprising the target sequence. In other words, the target RNA may be a RNA polynucleotide or a part of a RNA polynucleotide to which a part of the gRNA, i.e. the guide sequence, is designed to have complementarity and to which the effector function mediated by the complex comprising CRISPR effector protein and a gRNA is to be directed. In some embodiments, a target sequence is located in the nucleus or cytoplasm of a cell. The target sequence may be DNA. The target sequence may be any RNA sequence. In some embodiments, the target sequence may be a sequence within a RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nuclear RNA (snoRNA), double stranded RNA (dsRNA), non coding RNA (ncRNA), long non-coding RNA (lncRNA), and small cytoplasmic RNA (scRNA). In some preferred embodiments, the target sequence may be a sequence within a RNA molecule selected from the group consisting of mRNA, pre-mRNA, and rRNA. In some preferred embodiments, the target sequence may be a sequence within a RNA molecule selected from the group consisting of ncRNA, and lncRNA. In some more preferred embodiments, the target sequence may be a sequence within an mRNA molecule or a pre-mRNA molecule.

In certain embodiments, the spacer length of the guide RNA is less than 28 nucleotides. In certain embodiments, the spacer length of the guide RNA is at least 18 nucleotides and less than 28 nucleotides. In certain embodiments, the spacer length of the guide RNA is between 19 and 28 nucleotides. In certain embodiments, the spacer length of the guide RNA is between 19 and 25 nucleotides. In certain embodiments, the spacer length of the guide RNA is 20 nucleotides. In certain embodiments, the spacer length of the guide RNA is 23 nucleotides. In certain embodiments, the spacer length of the guide RNA is 25 nucleotides.

In certain embodiments, modulations of cleavage efficiency can be exploited by introduction of mismatches, e.g. 1 or more mismatches, such as 1 or 2 mismatches between spacer sequence and target sequence, including the position of the mismatch along the spacer/target. The more central (i.e. not 3' or 5') for instance a double mismatch is, the more cleavage efficiency is affected. Accordingly, by choosing mismatch position along the spacer, cleavage efficiency can be modulated. By means of example, if less than 100% cleavage of targets is desired (e.g. in a cell population), 1 or more, such as preferably 2 mismatches between spacer and target sequence may be introduced in the spacer sequences. The more central along the spacer of the mismatch position, the lower the cleavage percentage.

In certain example embodiments, the cleavage efficiency may be exploited to design single guides that can distinguish two or more targets that vary by a single nucleotide, such as a single nucleotide polymorphism (SNP), variation, or (point) mutation. The CRISPR effector may have reduced sensitivity to SNPs (or other single nucleotide variations) and continue to cleave SNP targets with a certain level of efficiency. Thus, for two targets, or a set of targets, a guide RNA may be designed with a nucleotide sequence that is complementary to one of the targets i.e. the on-target SNP. The guide RNA is further designed to have a synthetic mismatch. As used herein a "synthetic mismatch" refers to a non-naturally occurring mismatch that is introduced upstream or downstream of the naturally occurring SNP, such as at most 5 nucleotides upstream or downstream, for instance 4, 3, 2, or 1 nucleotide upstream or downstream, preferably at most 3 nucleotides upstream or downstream, more preferably at most 2 nucleotides upstream or downstream, most preferably 1 nucleotide upstream or downstream (i.e. adjacent the SNP). When the CRISPR effector binds to the on-target SNP, only a single mismatch will be formed with the synthetic mismatch and the CRISPR effector will continue to be activated and a detectable signal produced. When the guide RNA hybridizes to an off-target SNP, two mismatches will be formed, the mismatch from the SNP and the synthetic mismatch, and no detectable signal generated. Thus, the systems disclosed herein may be designed to distinguish SNPs within a population. For, example the systems may be used to distinguish pathogenic strains that differ by a single SNP or detect certain disease specific SNPs, such as but not limited to, disease associated SNPs, such as without limitation cancer associated SNPs.

In certain embodiments, the guide RNA is designed such that the SNP is located on position 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the spacer sequence (starting at the 5' end). In certain embodiments, the guide RNA is designed such that the SNP is located on position 1, 2, 3, 4, 5, 6, 7, 8, or 9 of the spacer sequence (starting at the 5' end). In certain embodiments, the guide RNA is designed such that the SNP is located on position 2, 3, 4, 5, 6, or 7 of the spacer sequence (starting at the 5' end). In certain embodiments, the guide RNA is designed such that the SNP is located on position 3, 4, 5, or 6 of the spacer sequence (starting at the 5' end). In certain embodiments, the guide RNA is designed such that the SNP is located on position 3 of the spacer sequence (starting at the 5' end).

In certain embodiments, the guide RNA is designed such that the mismatch (e.g. the synthetic mismatch, i.e. an additional mutation besides a SNP) is located on position 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 of the spacer sequence (starting at the 5' end). In certain embodiments, the guide RNA is designed such that the mismatch is located on position 1, 2, 3, 4, 5, 6, 7, 8, or 9 of the spacer sequence (starting at the 5' end). In certain embodiments, the guide RNA is designed such that the mismatch is located on position 4, 5, 6, or 7 of the spacer sequence (starting at the 5' end. In certain embodiments, the guide RNA is designed such that the mismatch is located on position 5 of the spacer sequence (starting at the 5' end).

In certain embodiments, the guide RNA is designed such that the mismatch is located 2 nucleotides upstream of the SNP (i.e. one intervening nucleotide).

In certain embodiments, the guide RNA is designed such that the mismatch is located 2 nucleotides downstream of the SNP (i.e. one intervening nucleotide).

In certain embodiments, the guide RNA is designed such that the mismatch is located on position 5 of the spacer sequence (starting at the 5' end) and the SNP is located on position 3 of the spacer sequence (starting at the 5' end).

The embodiments described herein comprehend inducing one or more nucleotide modifications in a eukaryotic cell (in vitro, i.e. in an isolated eukaryotic cell) as herein discussed comprising delivering to cell a vector as herein discussed. The mutation(s) can include the introduction, deletion, or substitution of one or more nucleotides at each target sequence of cell(s) via the guide(s) RNA(s). The mutations can include the introduction, deletion, or substitution of 1-75 nucleotides at each target sequence of said cell(s) via the guide(s) RNA(s). The mutations can include the introduction, deletion, or substitution of 1, 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 5, 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations include the introduction, deletion, or substitution of 10, 11, 12, 13, 14, 15, 16, 17, 18, 19, 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 20, 21, 22, 23, 24, 25, 26, 27, 28, 29, 30, 35, 40, 45, 50, or 75 nucleotides at each target sequence of said cell(s) via the guide(s) RNA(s). The mutations can include the introduction, deletion, or substitution of 40, 45, 50, 75, 100, 200, 300, 400 or 500 nucleotides at each target sequence of said cell(s) via the guide(s) RNA(s).

Typically, in the context of an endogenous CRISPR system, formation of a CRISPR complex (comprising a guide sequence hybridized to a target sequence and complexed with one or more Cas proteins) results in cleavage in or near (e.g. within 1, 2, 3, 4, 5, 6, 7, 8, 9, 10, 20, 50, or more base pairs from) the target sequence, but may depend on for instance secondary structure, in particular in the case of RNA targets.

RNA-Based Masking Constructs

As used herein, a "masking construct" refers to a molecule that can be cleaved or otherwise deactivated by an activated CRISPR system effector protein described herein. The term "masking construct" may also be referred to in the alternative as a "detection construct." In certain example embodiments, the masking construct is a RNA-based masking construct. The RNA-based masking construct comprises a RNA element that is cleavable by a CRISPR effector protein. Cleavage of the RNA element releases agents or produces conformational changes that allow a detectable signal to be produced. Example constructs demonstrating how the RNA element may be used to prevent or mask generation of detectable signal are described below and embodiments of the invention comprise variants of the same. Prior to cleavage, or when the masking construct is in an 'active' state, the masking construct blocks the generation or detection of a positive detectable signal. It will be understood that in certain example embodiments a minimal background signal may be produced in the presence of an active RNA masking construct. A positive detectable signal may be any signal that can be detected using optical, fluorescent, chemiluminescent, electrochemical or other detection methods known in the art. The term "positive detectable signal" is used to differentiate from other detectable signals that may be detectable in the presence of the masking construct. For example, in certain embodiments a first signal may be detected when the masking agent is present (i.e. a negative detectable signal), which then converts to a second signal (e.g. the positive detectable signal) upon detection of the target molecules and cleavage or deactivation of the masking agent by the activated CRISPR effector protein.

In certain example embodiments, the masking construct may suppress generation of a gene product. The gene product may be encoded by a reporter construct that is added to the sample. The masking construct may be an interfering RNA involved in a RNA interference pathway, such as a short hairpin RNA (shRNA) or small interfering RNA (siRNA). The masking construct may also comprise microRNA (miRNA). While present, the masking construct suppresses expression of the gene product. The gene product may be a fluorescent protein or other RNA transcript or proteins that would otherwise be detectable by a labeled probe, aptamer, or antibody but for the presence of the masking construct. Upon activation of the effector protein the masking construct is cleaved or otherwise silenced allowing for expression and detection of the gene product as the positive detectable signal.

In certain example embodiments, the masking construct may sequester one or more reagents needed to generate a detectable positive signal such that release of the one or more reagents from the masking construct results in generation of the detectable positive signal. The one or more reagents may combine to produce a colorimetric signal, a chemiluminescent signal, a fluorescent signal, or any other detectable signal and may comprise any reagents known to be suitable for such purposes. In certain example embodiments, the one or more reagents are sequestered by RNA aptamers that bind the one or more reagents. The one or more reagents are released when the effector protein is activated upon detection of a target molecule and the RNA aptamers are degraded.

In certain example embodiments, the masking construct may be immobilized on a solid substrate in an individual discrete volume (defined further below) and sequesters a single reagent. For example, the reagent may be a bead comprising a dye. When sequestered by the immobilized reagent, the individual beads are too diffuse to generate a detectable signal, but upon release from the masking construct are able to generate a detectable signal, for example by aggregation or simple increase in solution concentration. In certain example embodiments, the immobilized masking agent is a RNA-based aptamer that can be cleaved by the activated effector protein upon detection of a target molecule.

In certain other example embodiments, the masking construct binds to an immobilized reagent in solution thereby blocking the ability of the reagent to bind to a separate labeled binding partner that is free in solution. Thus, upon application of a washing step to a sample, the labeled binding partner can be washed out of the sample in the absence of a target molecule. However, if the effector protein is activated, the masking construct is cleaved to a degree sufficient to interfere with the ability of the masking construct to bind the reagent thereby allowing the labeled binding partner to bind to the immobilized reagent. Thus, the labeled binding partner remains after the wash step indicating the presence of the target molecule in the sample. In certain aspects, the masking construct that binds the immobilized reagent is a RNA aptamer. The immobilized reagent may be a protein and the labeled minding partner may be a labeled antibody. Alternatively, the immobilized reagent may be streptavidin and the labeled binding partner may be labeled biotin. The label on the binding partner used in the above embodiments may be any detectable label known in the art. In addition, other known binding partners may be used in accordance with the overall design described herein.

In certain example embodiments, the masking construct may comprise a ribozyme. Ribozymes are RNA molecules having catalytic properties. Ribozymes, both naturally and engineered, comprise or consist of RNA that may be targeted by the effector proteins disclosed herein. The ribozyme may be selected or engineered to catalyze a reaction that either generates a negative detectable signal or prevents generation of a positive control signal. Upon deactivation of the ribozyme by the activated effector protein the reaction generating a negative control signal, or preventing generation of a positive detectable signal, is removed thereby allowing a positive detectable signal to be generated. In one example embodiment, the ribozyme may catalyze a colorimetric reaction causing a solution to appear as a first color. When the ribozyme is deactivated the solution then turns to a second color, the second color being the detectable positive signal. An example of how ribozymes can be used to catalyze a colorimetric reaction are described in Zhao et al. "Signal amplification of glucosamine-6-phosphate based on ribozyme glmS," *Biosens Bioelectron.* 2014; 16:337-42, and provide an example of how such a system could be modified to work in the context of the embodiments disclosed herein. Alternatively, ribozymes, when present can generate cleavage products of, for example, RNA transcripts. Thus, detection of a positive detectable signal may comprise detection of non-cleaved RNA transcripts that are only generated in the absence of the ribozyme.

In certain example embodiments, the one or more reagents is a protein, such as an enzyme, capable of facilitating generation of a detectable signal, such as a colorimetric, chemiluminescent, or fluorescent signal, that is inhibited or sequestered such that the protein cannot generate the detectable signal by the binding of one or more RNA aptamers to the protein. Upon activation of the effector proteins disclosed herein, the RNA aptamers are cleaved or degraded to an extent that they no longer inhibit the protein's ability to generate the detectable signal. In certain example embodiments, the aptamer is a thrombin inhibitor aptamer. In certain example embodiments the thrombin inhibitor aptamer has a sequence of GGGAACAAAGCUGAAGUACUUACCC (SEQ ID NO: 414). When this aptamer is cleaved, thrombin will become active and will cleave a peptide colorimetric or fluorescent substrate. In certain example embodiments, the colorimetric substrate is para-nitroanilide (pNA) covalently linked to the peptide substrate for thrombin. Upon cleavage by thrombin, pNA is released and becomes yellow in color and easily visible to the eye. In certain example embodiments, the fluorescent substrate is 7-amino-4-methylcoumarin a blue fluorophore that can be detected using a fluorescence detector. Inhibitory aptamers may also be used for horseradish peroxidase (HRP), beta-galactosidase, or calf alkaline phosphatase (CAP) and within the general principals laid out above.

In certain embodiments, RNAse activity is detected colorimetrically via cleavage of enzyme-inhibiting aptamers. One potential mode of converting RNAse activity into a colorimetric signal is to couple the cleavage of an RNA aptamer with the re-activation of an enzyme that is capable of producing a colorimetric output. In the absence of RNA cleavage, the intact aptamer will bind to the enzyme target and inhibit its activity. The advantage of this readout system is that the enzyme provides an additional amplification step: once liberated from an aptamer via collateral activity (e.g. Cas13a collateral activity), the colorimetric enzyme will continue to produce colorimetric product, leading to a multiplication of signal.

In certain embodiments, an existing aptamer that inhibits an enzyme with a colorimetric readout is used. Several aptamer/enzyme pairs with colorimetric readouts exist, such as thrombin, protein C, neutrophil elastase, and subtilisin. These proteases have colorimetric substrates based upon pNA and are commercially available. In certain embodiments, a novel aptamer targeting a common colorimetric enzyme is used. Common and robust enzymes, such as beta-galactosidase, horseradish peroxidase, or calf intestinal alkaline phosphatase, could be targeted by engineered aptamers designed by selection strategies such as SELEX. Such strategies allow for quick selection of aptamers with nanomolar binding efficiencies and could be used for the development of additional enzyme/aptamer pairs for colorimetric readout.

In certain embodiments, RNAse activity is detected colorimetrically via cleavage of RNA-tethered inhibitors. Many common colorimetric enzymes have competitive, reversible inhibitors: for example, beta-galactosidase can be inhibited by galactose. Many of these inhibitors are weak, but their effect can be increased by increases in local concentration. By linking local concentration of inhibitors to RNAse activity, colorimetric enzyme and inhibitor pairs can be engineered into RNAse sensors. The colorimetric RNAse sensor based upon small-molecule inhibitors involves three components: the colorimetric enzyme, the inhibitor, and a bridging RNA that is covalently linked to both the inhibitor and enzyme, tethering the inhibitor to the enzyme. In the uncleaved configuration, the enzyme is inhibited by the increased local concentration of the small molecule; when the RNA is cleaved (e.g. by Cas13a collateral cleavage), the inhibitor will be released and the colorimetric enzyme will be activated.

In certain embodiments, RNAse activity is detected colorimetrically via formation and/or activation of G-quadruplexes. G quadruplexes in DNA can complex with heme (iron (III)-protoporphyrin IX) to form a DNAzyme with peroxidase activity. When supplied with a peroxidase substrate (e.g. ABTS: (2,2'-Azinobis [3-ethylbenzothiazoline-6-sulfonic acid]-diammonium salt)), the G-quadraplex-heme complex in the presence of hydrogen peroxide causes oxidation of the substrate, which then forms a green color in solution. An example G-quadraplex forming DNA sequence is: GGGTAGGGCGGGTTGGGA (SEQ. I.D. No. 415). By hybridizing an RNA sequence to this DNA aptamer, formation of the G-quadraplex structure will be limited. Upon RNAse collateral activation (e.g. C2c2-complex collateral activation), the RNA staple will be cleaved allowing the G quadraplex to form and heme to bind. This strategy is particularly appealing because color formation is enzymatic, meaning there is additional amplification beyond RNAse activation.

In certain example embodiments, the masking construct may be immobilized on a solid substrate in an individual discrete volume (defined further below) and sequesters a single reagent. For example, the reagent may be a bead comprising a dye. When sequestered by the immobilized reagent, the individual beads are too diffuse to generate a detectable signal, but upon release from the masking construct are able to generate a detectable signal, for example by aggregation or simple increase in solution concentration. In certain example embodiments, the immobilized masking agent is a RNA-based aptamer that can be cleaved by the activated effector protein upon detection of a target molecule.

Figure 43:
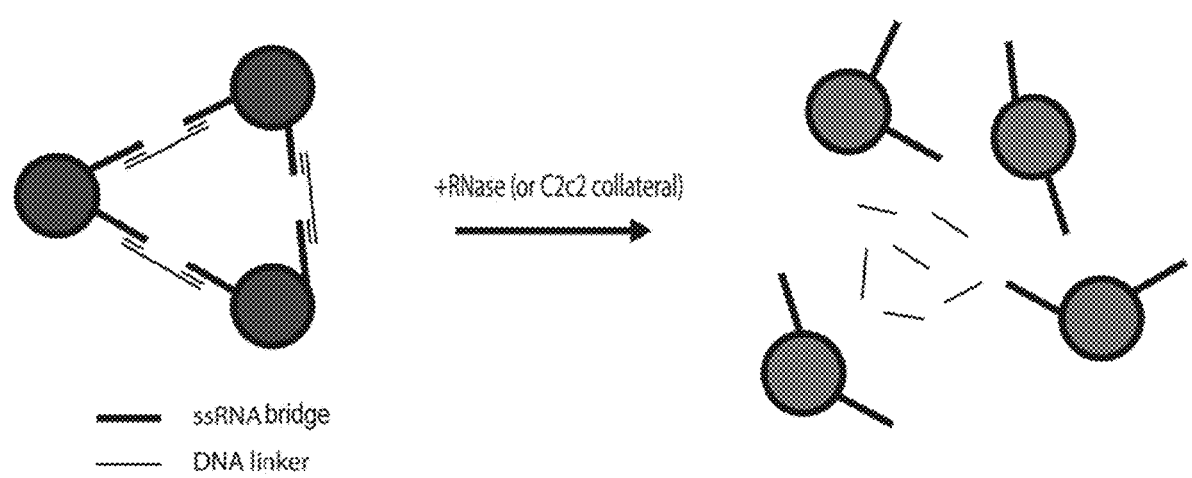
FIG. 43 is a schematic of a gold nanoparticle colorimetric based assay. AuNPs are aggregated using a combination of DNA linkers and an RNA bridge. Upon addition of RNase activity the ssRNA bridge is cleaved and the AuNPs are released, causing a characteristic color shift toward red.
Figure 44:
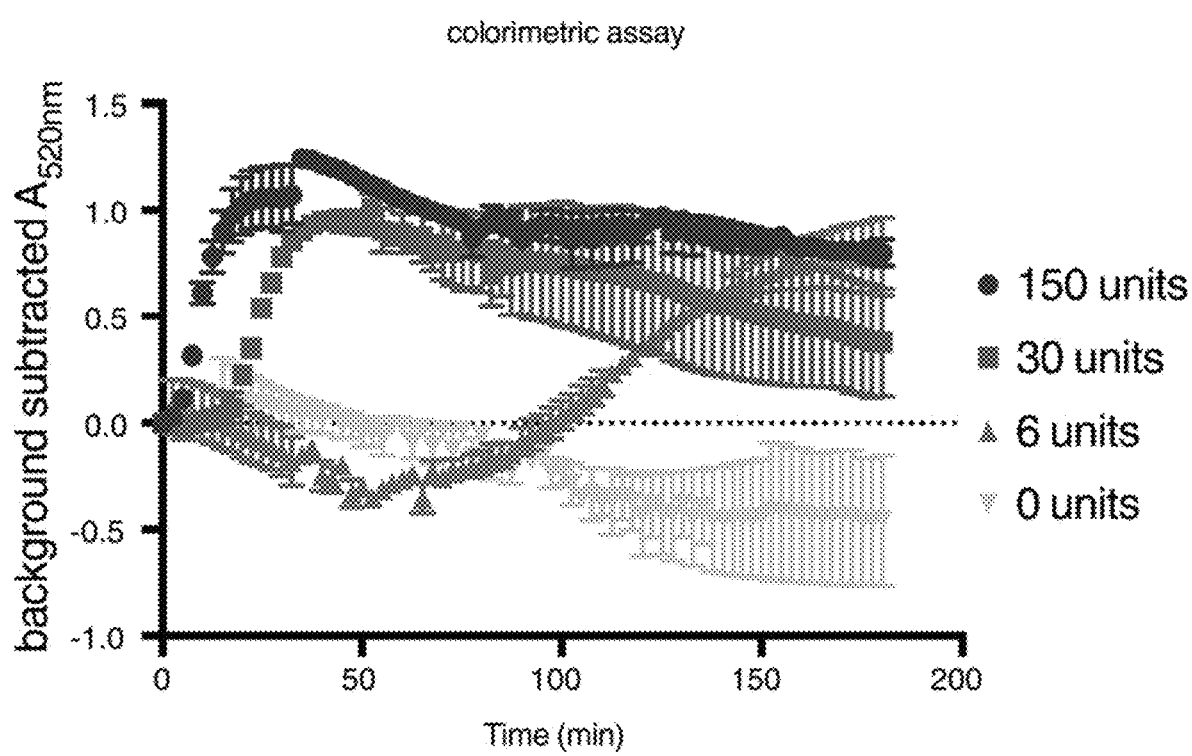
FIG. 44 is a graph showing the ability to detect the shift in color of dispersed nanoparticles at 520 nm. The nanoparticles were based on the example embodiment shown in FIG. 43 and dispersed using addition of RNase A at varying concentrations.
Figure 45:
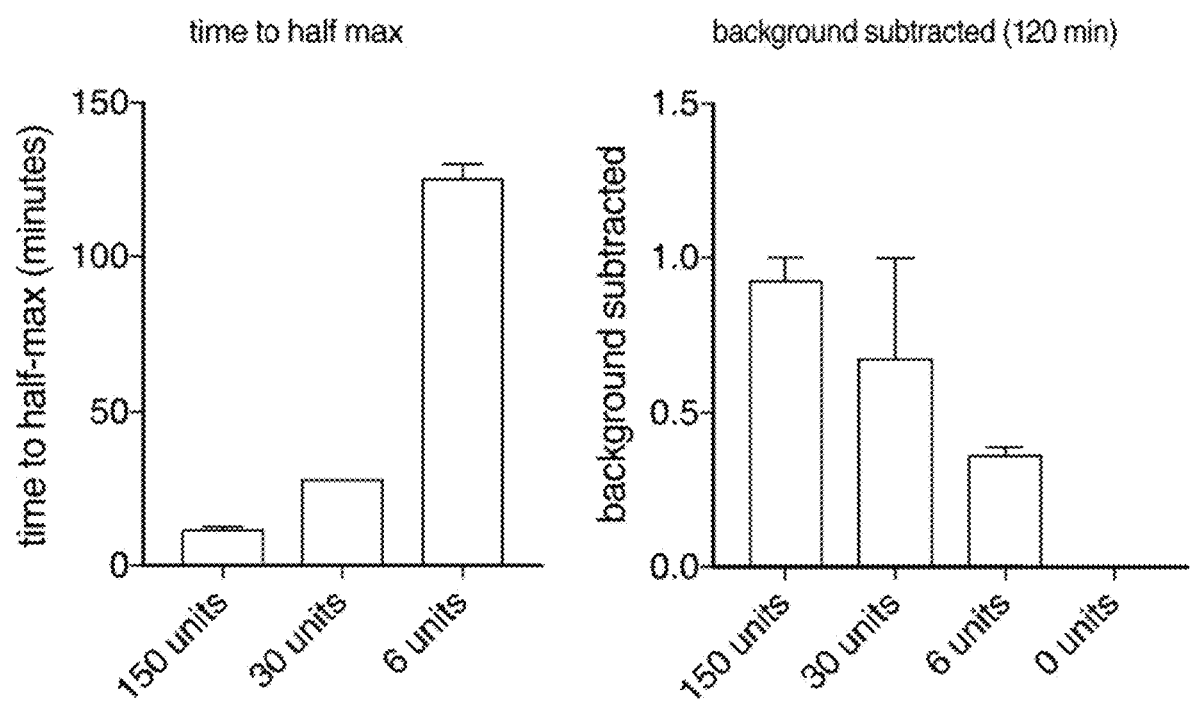
FIG. 45 is a set of graphs showing that the RNase colorimetric test is quantitative.
Figure 46:
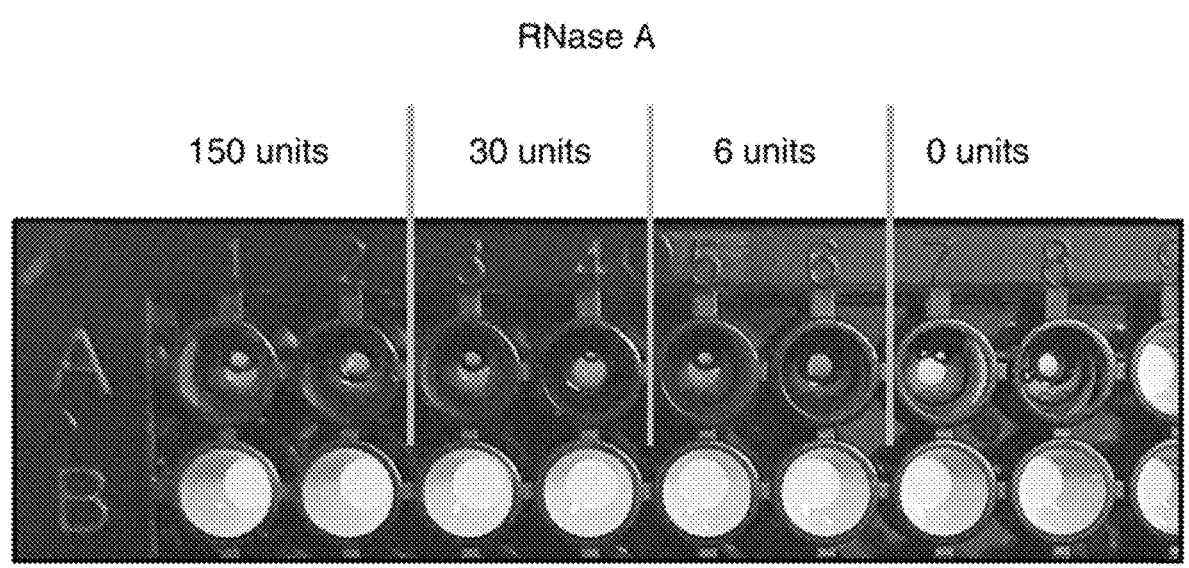
FIG. 46 is a picture of a microwell plate showing that the color shift in the dispersed nanoparticle is visually detectable.
Figure 48A:
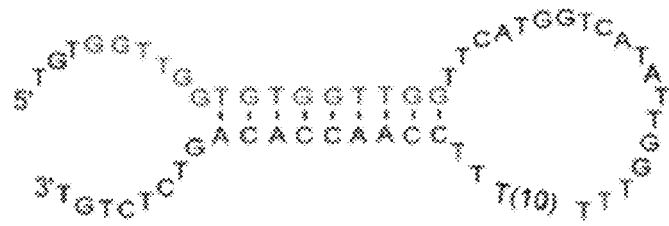
FIG. 48A is a schematic of a conformation switching aptamer in accordance with certain example embodiments for detection of protein or small molecules.
Figure 48B:
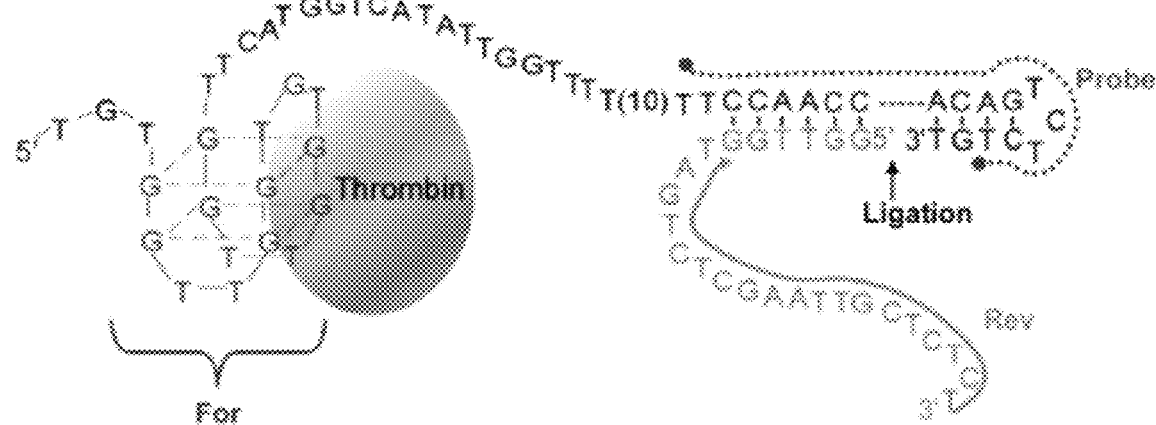
FIG. 48B shows the ligated product used as a complete target for the RNA-targeting effector, which cannot detect the unligated input product (SEQ. I.D. Nos. 202 and 424).
Figure 49:
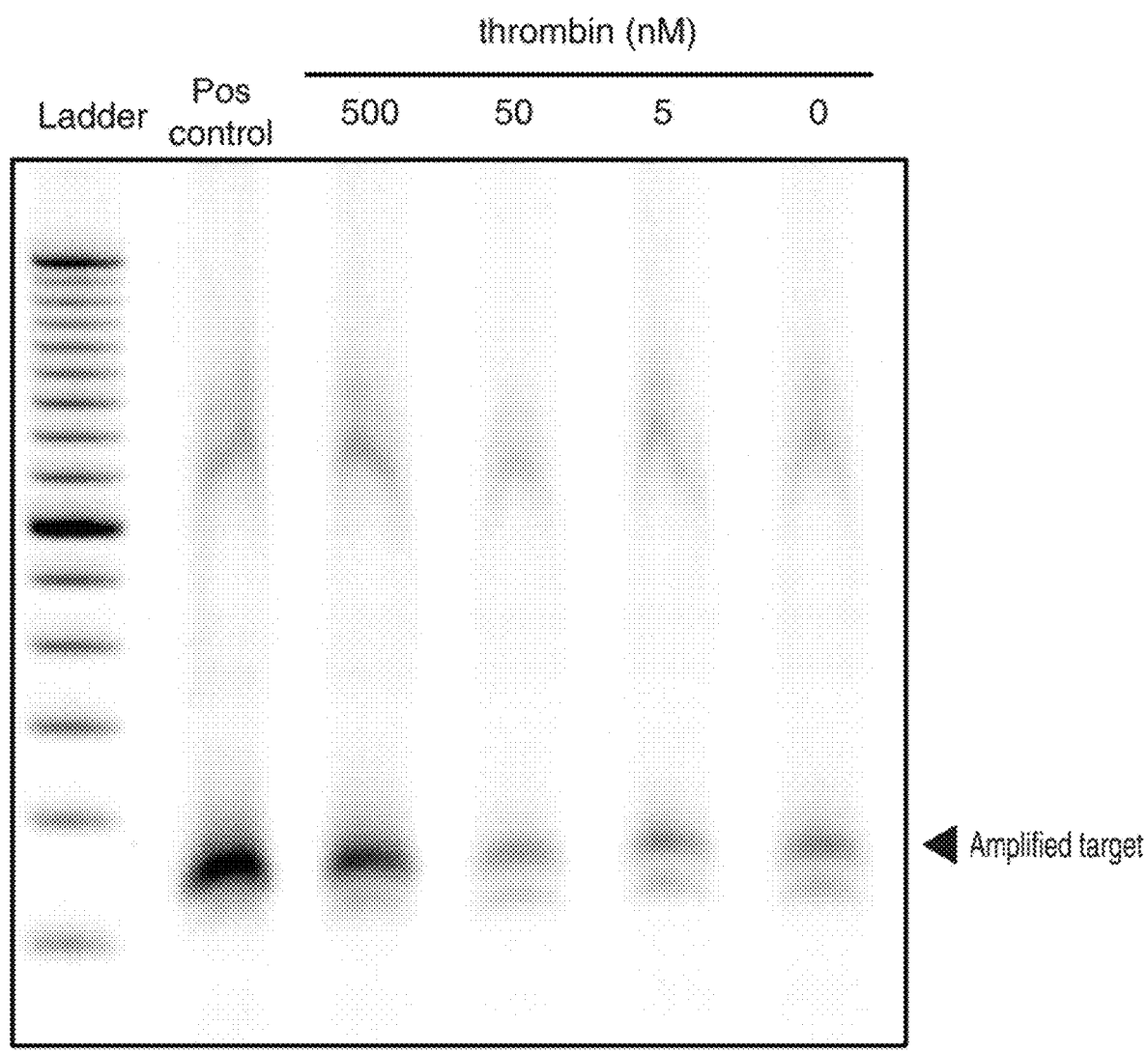
FIG. 49 is an image of a gel showing that aptamer-based ligation can create RPA-detectable substrates. Aptamers were incubated with various levels of thrombin and then ligated with probe. Ligated constructs were used as templates for a 3 minute RPA reaction. 500 nM thrombin has significantly higher levels of amplified target than background.

In one example embodiment, the masking construct comprises a detection agent that changes color depending on whether the detection agent is aggregated or dispersed in solution. For example, certain nanoparticles, such as colloidal gold, undergo a visible purple to red color shift as they move from aggregates to dispersed particles. Accordingly, in certain example embodiments, such detection agents may be held in aggregate by one or more bridge molecules. See e.g. FIG. 43. At least a portion of the bridge molecule comprises RNA. Upon activation of the effector proteins disclosed herein, the RNA portion of the bridge molecule is cleaved allowing the detection agent to disperse and resulting in the corresponding change in color. See e.g. FIG. 46. In certain example embodiments the, bridge molecule is a RNA molecule. In certain example embodiments, the detection agent is a colloidal metal. The colloidal metal material may include water-insoluble metal particles or metallic compounds dispersed in a liquid, a hydrosol, or a metal sol. The colloidal metal may be selected from the metals in groups IA, IB, IIB and MB of the periodic table, as well as the transition metals, especially those of group VIII. Preferred metals include gold, silver, aluminum, ruthenium, zinc, iron, nickel and calcium. Other suitable metals also include the following in all of their various oxidation states: lithium, sodium, magnesium, potassium, scandium, titanium, vanadium, chromium, manganese, cobalt, copper, gallium, strontium, niobium, molybdenum, palladium, indium, tin, tungsten, rhenium, platinum, and gadolinium. The metals are preferably provided in ionic form, derived from an appropriate metal compound, for example the $Al3+$, $Ru3+$, $Zn2+$, $Fe3+$, $Ni2+$ and $Ca2+$ ions.

When the RNA bridge is cut by the activated CRISPR effector, the beforementioned color shift is observed. In certain example embodiments the particles are colloidal metals. In certain other example embodiments, the colloidal metal is a colloidal gold. In certain example embodiments, the colloidal nanoparticles are 15 nm gold nanoparticles (AuNPs). Due to the unique surface properties of colloidal gold nanoparticles, maximal absorbance is observed at 520 nm when fully dispersed in solution and appear red in color to the naked eye. Upon aggregation of AuNPs, they exhibit a red-shift in maximal absorbance and appear darker in color, eventually precipitating from solution as a dark purple aggregate. In certain example embodiments the nanoparticles are modified to include DNA linkers extending from the surface of the nanoparticle. Individual particles are linked together by single-stranded RNA (ssRNA) bridges that hybridize on each end of the RNA to at least a portion of the DNA linkers. Thus, the nanoparticles will form a web of linked particles and aggregate, appearing as a dark precipitate. Upon activation of the CRISPR effectors disclosed herein, the ssRNA bridge will be cleaved, releasing the AU NPS from the linked mesh and producing a visible red color. Example DNA linkers and RNA bridge sequences are listed below. Thiol linkers on the end of the DNA linkers may be used for surface conjugation to the AuNPS. Other forms of conjugation may be used. In certain example embodiments, two populations of AuNPs may be generated, one for each DNA linker. This will help facilitate proper binding of the ssRNA bridge with proper orientation. In certain example embodiments, a first DNA linker is conjugated by the 3' end while a second DNA linker is conjugated by the 5' end.

TABLE 7

| | |
|---|---|
| C2c2 colorimetric DNA1 | TTATAACTATTCCTAAAAAAAAAAA/ 3ThioMC3-D/ (SEQ. I.D. No. 183) |
| C2c2 colorimetric DNA2 | /5ThioMC6-D/AAAAAAAAACTCCCCTAA TAACAAT (SEQ. I.D. No. 184) |
| C2c2 colorimetric bridge | GGGUAGGAAUAGUUAUAAUUUCCCUUUCCCA UUGUUAUUAGGGAG (SEQ. I.D. No. 185) |

In certain other example embodiments, the masking construct may comprise an RNA oligonucleotide to which are attached a detectable label and a masking agent of that detectable label. An example of such a detectable label/masking agent pair is a fluorophore and a quencher of the fluorophore. Quenching of the fluorophore can occur as a result of the formation of a non-fluorescent complex between the fluorophore and another fluorophore or non-fluorescent molecule. This mechanism is known as ground-state complex formation, static quenching, or contact quenching. Accordingly, the RNA oligonucleotide may be designed so that the fluorophore and quencher are in sufficient proximity for contact quenching to occur. Fluorophores and their cognate quenchers are known in the art and can be selected for this purpose by one having ordinary skill in the art. The particular fluorophore/quencher pair is not critical in the context of this invention, only that selection of the fluorophore/quencher pairs ensures masking of the fluorophore. Upon activation of the effector proteins disclosed herein, the RNA oligonucleotide is cleaved thereby severing the proximity between the fluorophore and quencher needed to maintain the contact quenching effect. Accordingly, detection of the fluorophore may be used to determine the presence of a target molecule in a sample.

In certain other example embodiments, the masking construct may comprise one or more RNA oligonucleotides to which are attached one or more metal nanoparticles, such as gold nanoparticles. In some embodiments, the masking construct comprises a plurality of metal nanoparticles cross-linked by a plurality of RNA oligonucleotides forming a closed loop. In one embodiment, the masking construct comprises three gold nanoparticles crosslinked by three RNA oligonucleotides forming a closed loop. In some embodiments, the cleavage of the RNA oligonucleotides by the CRISPR effector protein leads to a detectable signal produced by the metal nanoparticles.

In certain other example embodiments, the masking construct may comprise one or more RNA oligonucleotides to which are attached one or more quantum dots. In some embodiments, the cleavage of the RNA oligonucleotides by the CRISPR effector protein leads to a detectable signal produced by the quantum dots.

In one example embodiment, the masking construct may comprise a quantum dot. The quantum dot may have multiple linker molecules attached to the surface. At least a portion of the linker molecule comprises RNA. The linker molecule is attached to the quantum dot at one end and to one or more quenchers along the length or at terminal ends of the linker such that the quenchers are maintained in sufficient proximity for quenching of the quantum dot to occur. The linker may be branched. As above, the quantum dot/quencher pair is not critical, only that selection of the quantum dot/quencher pair ensures masking of the fluorophore. Quantum dots and their cognate quenchers are known in the art and can be selected for this purpose by one having ordinary skill in the art. Upon activation of the effector proteins disclosed herein, the RNA portion of the linker molecule is cleaved thereby eliminating the proximity between the quantum dot and one or more quenchers needed to maintain the quenching effect. In certain example embodiments the quantum dot is streptavidin conjugated. RNA are attached via biotin linkers and recruit quenching molecules with the sequences /5Biosg/UCUCGUACGUUC/3IAbRQSp/ (SEQ ID NO. 416) or /5Biosg/UCUCGUACGUUCUCUCGUACGUUC/3IAbRQSp/ (SEQ ID NO. 417), where /5Biosg/ is a biotin tag and /3IAbRQSp/ is an Iowa black quencher. Upon cleavage, by the activated effectors disclosed herein the quantum dot will fluoresce visibly.

In a similar fashion, fluorescence energy transfer (FRET) may be used to generate a detectable positive signal. FRET is a non-radiative process by which a photon from an energetically excited fluorophore (i.e. "donor fluorophore") raises the energy state of an electron in another molecule (i.e. "the acceptor") to higher vibrational levels of the excited singlet state. The donor fluorophore returns to the ground state without emitting a fluoresce characteristic of that fluorophore. The acceptor can be another fluorophore or non-fluorescent molecule. If the acceptor is a fluorophore, the transferred energy is emitted as fluorescence characteristic of that fluorophore. If the acceptor is a non-fluorescent molecule the absorbed energy is loss as heat. Thus, in the context of the embodiments disclosed herein, the fluorophore/quencher pair is replaced with a donor fluorophore/acceptor pair attached to the oligonucleotide molecule. When intact, the masking construct generates a first signal (negative detectable signal) as detected by the fluorescence or heat emitted from the acceptor. Upon activation of the effector proteins disclosed herein the RNA oligonucleotide is cleaved and FRET is disrupted such that fluorescence of the donor fluorophore is now detected (positive detectable signal).

In certain example embodiments, the masking construct comprises the use of intercalating dyes which change their absorbance in response to cleavage of long RNAs to short nucleotides. Several such dyes exist. For example, pyronine-Y will complex with RNA and form a complex that has an absorbance at 572 nm. Cleavage of the RNA results in loss of absorbance and a color change. Methylene blue may be used in a similar fashion, with changes in absorbance at 688 nm upon RNA cleavage. Accordingly, in certain example embodiments the masking construct comprises a RNA and intercalating dye complex that changes absorbance upon the cleavage of RNA by the effector proteins disclosed herein.

In certain example embodiments, the masking construct may comprise an initiator for an HCR reaction. See e.g. Dirks and Pierce. PNAS 101, 15275-15728 (2004). HCR reactions utilize the potential energy in two hairpin species. When a single-stranded initiator having a portion of complementary to a corresponding region on one of the hairpins is released into the previously stable mixture, it opens a hairpin of one species. This process, in turn, exposes a single-stranded region that opens a hairpin of the other species. This process, in turn, exposes a single stranded region identical to the original initiator. The resulting chain reaction may lead to the formation of a nicked double helix that grows until the hairpin supply is exhausted. Detection of the resulting products may be done on a gel or colorimetrically. Example colorimetric detection methods include, for example, those disclosed in Lu et al. "Ultra-sensitive colorimetric assay system based on the hybridization chain reaction-triggered enzyme cascade amplification ACS Appl Mater Interfaces, 2017, 9(1):167-175, Wang et al. "An enzyme-free colorimetric assay using hybridization chain reaction amplification and split aptamers" Analyst 2015, 150, 7657-7662, and Song et al. "Non covalent fluorescent labeling of hairpin DNA probe coupled with hybridization chain reaction for sensitive DNA detection." Applied Spectroscopy, 70(4): 686-694 (2016).

In certain example embodiments, the masking construct may comprise a HCR initiator sequence and a cleavable structural element, such as a loop or hairpin, that prevents the initiator from initiating the HCR reaction. Upon cleavage of the structure element by an activated CRISPR effector protein, the initiator is then released to trigger the HCR reaction, detection thereof indicating the presence of one or more targets in the sample. In certain example embodiments, the masking construct comprises a hairpin with a RNA loop. When an activated CRISPR effector protein cuts the RNA loop, the initiator can be released to trigger the HCR reaction.

Amplification of Target

In certain example embodiments, target RNAs and/or DNAs may be amplified prior to activating the CRISPR effector protein. Any suitable RNA or DNA amplification technique may be used. In certain example embodiments, the RNA or DNA amplification is an isothermal amplification. In certain example embodiments, the isothermal amplification may be nucleic-acid sequenced-based amplification (NASBA), recombinase polymerase amplification (RPA), loop-mediated isothermal amplification (LAMP), strand displacement amplification (SDA), helicase-dependent amplification (HDA), or nicking enzyme amplification reaction (NEAR). In certain example embodiments, non-isothermal amplification methods may be used which include, but are not limited to, PCR, multiple displacement amplification (MDA), rolling circle amplification (RCA), ligase chain reaction (LCR), or ramification amplification method (RAM).

In certain example embodiments, the RNA or DNA amplification is NASBA, which is initiated with reverse transcription of target RNA by a sequence-specific reverse primer to create a RNA/DNA duplex. RNase H is then used to degrade the RNA template, allowing a forward primer containing a promoter, such as the T7 promoter, to bind and initiate elongation of the complementary strand, generating a double-stranded DNA product. The RNA polymerase promoter-mediated transcription of the DNA template then creates copies of the target RNA sequence. Importantly, each of the new target RNAs can be detected by the guide RNAs thus further enhancing the sensitivity of the assay. Binding of the target RNAs by the guide RNAs then leads to activation of the CRISPR effector protein and the methods proceed as outlined above. The NASBA reaction has the additional advantage of being able to proceed under moderate isothermal conditions, for example at approximately 41° C., making it suitable for systems and devices deployed for early and direct detection in the field and far from clinical laboratories.

In certain other example embodiments, a recombinase polymerase amplification (RPA) reaction may be used to amplify the target nucleic acids. RPA reactions employ recombinases which are capable of pairing sequence-specific primers with homologous sequence in duplex DNA. If target DNA is present, DNA amplification is initiated and no other sample manipulation such as thermal cycling or chemical melting is required. The entire RPA amplification system is stable as a dried formulation and can be transported safely without refrigeration. RPA reactions may also be carried out at isothermal temperatures with an optimum reaction temperature of 37-42° C. The sequence specific primers are designed to amplify a sequence comprising the target nucleic acid sequence to be detected. In certain example embodiments, a RNA polymerase promoter, such as a T7 promoter, is added to one of the primers. This results in an amplified double-stranded DNA product comprising the target sequence and a RNA polymerase promoter. After, or during, the RPA reaction, a RNA polymerase is added that will produce RNA from the double-stranded DNA templates. The amplified target RNA can then in turn be detected by the CRISPR effector system. In this way target DNA can be detected using the embodiments disclosed herein. RPA reactions can also be used to amplify target RNA. The target RNA is first converted to cDNA using a reverse transcriptase, followed by second strand DNA synthesis, at which point the RPA reaction proceeds as outlined above.

Accordingly, in certain example embodiments the systems disclosed herein may include amplification reagents. Different components or reagents useful for amplification of nucleic acids are described herein. For example, an amplification reagent as described herein may include a buffer, such as a Tris buffer. A Tris buffer may be used at any concentration appropriate for the desired application or use, for example including, but not limited to, a concentration of 1 mM, 2 mM, 3 mM, 4 mM, 5 mM, 6 mM, 7 mM, 8 mM, 9 mM, 10 mM, 11 mM, 12 mM, 13 mM, 14 mM, 15 mM, 25 mM, 50 mM, 75 mM, 1 M, or the like. One of skill in the art will be able to determine an appropriate concentration of a buffer such as Tris for use with the present invention.

A salt, such as magnesium chloride ($MgCl_2$), potassium chloride (KCl), or sodium chloride (NaCl), may be included in an amplification reaction, such as PCR, in order to improve the amplification of nucleic acid fragments. Although the salt concentration will depend on the particular reaction and application, in some embodiments, nucleic acid fragments of a particular size may produce optimum results at particular salt concentrations. Larger products may require altered salt concentrations, typically lower salt, in order to produce desired results, while amplification of smaller products may produce better results at higher salt concentrations. One of skill in the art will understand that the presence and/or concentration of a salt, along with alteration of salt concentrations, may alter the stringency of a biological or chemical reaction, and therefore any salt may be used that provides the appropriate conditions for a reaction of the present invention and as described herein.

Other components of a biological or chemical reaction may include a cell lysis component in order to break open or lyse a cell for analysis of the materials therein. A cell lysis component may include, but is not limited to, a detergent, a salt as described above, such as NaCl, KCl, ammonium sulfate [$(NH_4)_2SO_4$], or others. Detergents that may be appropriate for the invention may include Triton X-100, sodium dodecyl sulfate (SDS), CHAPS (3-[(3-cholamidopropyl)dimethylammonio]-1-propanesulfonate), ethyl trimethyl ammonium bromide, nonyl phenoxypolyethoxylethanol (NP-40). Concentrations of detergents may depend on the particular application, and may be specific to the reaction in some cases. Amplification reactions may include dNTPs and nucleic acid primers used at any concentration appropriate for the invention, such as including, but not limited to, a concentration of 100 nM, 150 nM, 200 nM, 250 nM, 300 nM, 350 nM, 400 nM, 450 nM, 500 nM, 550 nM, 600 nM, 650 nM, 700 nM, 750 nM, 800 nM, 850 nM, 900 nM, 950 nM, 1 mM, 2 mM, 3 mM, 4 mM, 5 mM, 6 mM, 7 mM, 8 mM, 9 mM, 10 mM, 20 mM, 30 mM, 40 mM, 50 mM, 60 mM, 70 mM, 80 mM, 90 mM, 100 mM, 150 mM, 200 mM, 250 mM, 300 mM, 350 mM, 400 mM, 450 mM, 500 mM, or the like. Likewise, a polymerase useful in accordance with the invention may be any specific or general polymerase known in the art and useful or the invention, including Taq polymerase, Q5 polymerase, or the like.

In some embodiments, amplification reagents as described herein may be appropriate for use in hot-start amplification. Hot start amplification may be beneficial in some embodiments to reduce or eliminate dimerization of adaptor molecules or oligos, or to otherwise prevent unwanted amplification products or artifacts and obtain optimum amplification of the desired product. Many components described herein for use in amplification may also be used in hot-start amplification. In some embodiments, reagents or components appropriate for use with hot-start amplification may be used in place of one or more of the composition components as appropriate. For example, a polymerase or other reagent may be used that exhibits a desired activity at a particular temperature or other reaction condition. In some embodiments, reagents may be used that are designed or optimized for use in hot-start amplification, for example, a polymerase may be activated after transposition or after reaching a particular temperature. Such polymerases may be antibody-based or aptamer-based. Polymerases as described herein are known in the art. Examples of such reagents may include, but are not limited to, hot-start polymerases, hot-start dNTPs, and photo-caged dNTPs. Such reagents are known and available in the art. One of skill in the art will be able to determine the optimum temperatures as appropriate for individual reagents.

Amplification of nucleic acids may be performed using specific thermal cycle machinery or equipment, and may be performed in single reactions or in bulk, such that any desired number of reactions may be performed simultaneously. In some embodiments, amplification may be performed using microfluidic or robotic devices, or may be performed using manual alteration in temperatures to achieve the desired amplification. In some embodiments, optimization may be performed to obtain the optimum reactions conditions for the particular application or materials. One of skill in the art will understand and be able to optimize reaction conditions to obtain sufficient amplification.

In certain embodiments, detection of DNA with the methods or systems of the invention requires transcription of the (amplified) DNA into RNA prior to detection.

Target RNA/DNA Enrichment

In certain example embodiments, target RNA or DNA may first be enriched prior to detection or amplification of the target RNA or DNA. In certain example embodiments, this enrichment may be achieved by binding of the target nucleic acids by a CRISPR effector system.

Current target-specific enrichment protocols require single-stranded nucleic acid prior to hybridization with probes. Among various advantages, the present embodiments can skip this step and enable direct targeting to double-stranded DNA (either partly or completely double-stranded). In addition, the embodiments disclosed herein are enzyme-driven targeting methods that offer faster kinetics and easier workflow allowing for isothermal enrichment. In certain example embodiments enrichment may take place at temperatures as low as 20-37° C. In certain example embodiments, a set of guide RNAs to different target nucleic acids are used in a single assay, allowing for detection of multiple targets and/or multiple variants of a single target.

In certain example embodiments, a dead CRISPR effector protein may bind the target nucleic acid in solution and then subsequently be isolated from said solution. For example, the dead CRISPR effector protein bound to the target nucleic acid, may be isolated from the solution using an antibody or other molecule, such as an aptamer, that specifically binds the dead CRISPR effector protein.

In other example embodiments, the dead CRISPR effector protein may bound to a solid substrate. A fixed substrate may refer to any material that is appropriate for or can be modified to be appropriate for the attachment of a polypeptide or a polynucleotide. Possible substrates include, but are not limited to, glass and modified functionalized glass, plastics (including acrylics, polystyrene and copolymers of styrene and other materials, polypropylene, polyethylene, polybutylene, polyurethanes, Teflon™, etc.), polysaccharides, nylon or nitrocellulose, ceramics, resins, silica or silica-based materials including silicon and modified silicon, carbon, metals, inorganic glasses, plastics, optical fiber bundles, and a variety of other polymers. In some embodiments, the solid support comprises a patterned surface suitable for immobilization of molecules in an ordered pattern. In certain embodiments a patterned surface refers to an arrangement of different regions in or on an exposed layer of a solid support. In some embodiments, the solid support comprises an array of wells or depressions in a surface. The composition and geometry of the solid support can vary with its use. In some embodiments, the solids support is a planar structure such as a slide, chip, microchip and/or array. As such, the surface of the substrate can be in the form of a planar layer. In some embodiments, the solid support comprises one or more surfaces of a flowcell. The term "flowcell" as used herein refers to a chamber comprising a solid surface across which one or more fluid reagents can be flowed. Example flowcells and related fluidic systems and detection platforms that can be readily used in the methods of the present disclosure are described, for example, in Bentley et al. Nature 456:53-59 (2008), WO 04/0918497, U.S. Pat. No. 7,057,026; WO 91/06678; WO 07/123744; U.S. Pat. Nos. 7,329,492; 7,211,414; 7,315,019; 7,405,281, and US 2008/0108082. In some embodiments, the solid support or its surface is non-planar, such as the inner or outer surface of a tube or vessel. In some embodiments, the solid support comprise microspheres or beads. "Microspheres," "bead," "particles," are intended to mean within the context of a solid substrate to mean small discrete particles made of various material including, but not limited to, plastics, ceramics, glass, and polystyrene. In certain embodiments, the microspheres are magnetic microspheres or beads. Alternatively or additionally, the beads may be porous. The bead sizes range from nanometers, e.g. 100 nm, to millimeters, e.g. 1 mm.

A sample containing, or suspected of containing, the target nucleic acids may then be exposed to the substrate to allow binding of the target nucleic acids to the bound dead CRISPR effector protein. Non-target molecules may then be washed away. In certain example embodiments, the target nucleic acids may then be released from the CRISPR effector protein/guide RNA complex for further detection using the methods disclosed herein. In certain example embodiments, the target nucleic acids may first be amplified as described herein.

In certain example embodiments, the CRISPR effector may be labeled with a binding tag. In certain example embodiments the CRISPR effector may be chemically tagged. For example, the CRISPR effector may be chemically biotinylated. In another example embodiment, a fusion may be created by adding additional sequence encoding a fusion to the CRISPR effector. One example of such a fusion is an AviTag™, which employs a highly targeted enzymatic conjugation of a single biotin on a unique 15 amino acid peptide tag. In certain embodiments, the CRISPR effector may be labeled with a capture tag such as, but not limited to, GST, Myc, hemagglutinin (HA), green fluorescent protein (GFP), flag, His tag, TAP tag, and Fc tag. The binding tag, whether a fusion, chemical tag, or capture tag, may be used to either pull down the CRISPR effector system once it has bound a target nucleic acid or to fix the CRISPR effector system on the solid substrate.

In certain example embodiments, the guide RNA may be labeled with a binding tag. In certain example embodiments, the entire guide RNA may be labeled using in vitro transcription (IVT) incorporating one or more biotinylated nucleotides, such as, biotinylated uracil. In some embodiments, biotin can be chemically or enzymatically added to the guide RNA, such as, the addition of one or more biotin groups to the 3' end of the guide RNA. The binding tag may be used to pull down the guide RNA/target nucleic acid complex after binding has occurred, for example, by exposing the guide RNA/target nucleic acid to a streptavidin coated solid substrate.

Accordingly, in certain example embodiments, an engineered or non-naturally-occurring CRISPR effector may be used for enrichment purposes. In an embodiment, the modification may comprise mutation of one or more amino acid residues of the effector protein. The one or more mutations may be in one or more catalytically active domains of the effector protein. The effector protein may have reduced or abolished nuclease activity compared with an effector protein lacking said one or more mutations. The effector protein may not direct cleavage of the RNA strand at the target locus of interest. In a preferred embodiment, the one or more mutations may comprise two mutations. In a preferred embodiment the one or more amino acid residues are modified in a C2c2 effector protein, e.g., an engineered or non-naturally-occurring effector protein or C2c2. In particular embodiments, the one or more modified of mutated amino acid residues are one or more of those in C2c2 corresponding to R597, H602, R1278 and H1283 (referenced to Lsh C2c2 amino acids), such as mutations R597A, H602A, R1278A and H1283A, or the corresponding amino acid residues in Lsh C2c2 orthologues.

In particular embodiments, the one or more modified of mutated amino acid residues are one or more of those in C2c2 corresponding to K2, K39, V40, E479, L514, V518, N524, G534, K535, E580, L597, V602, D630, F676, L709, 1713, R717 (HEPN), N718, H722 (HEPN), E773, P823, V828, 1879, Y880, F884, Y997, L1001, F1009, L1013, Y1093, L1099, L1111, Y1114, L1203, D1222, Y1244, L1250, L1253, K1261, 11334, L1355, L1359, R1362, Y1366, E1371, R1372, D1373, R1509 (HEPN), H1514 (HEPN), Y1543, D1544, K1546, K1548, V1551, I1558, according to C2c2 consensus numbering. In certain embodiments, the one or more modified of mutated amino acid residues are one or more of those in C2c2 corresponding to R717 and R1509. In certain embodiments, the one or more modified of mutated amino acid residues are one or more of those in C2c2 corresponding to K2, K39, K535, K1261, R1362, R1372, K1546 and K1548. In certain embodiments, said mutations result in a protein having an altered or modified activity. In certain embodiments, said mutations result in a protein having a reduced activity, such as reduced specificity. In certain embodiments, said mutations result in a protein having no catalytic activity (i.e. "dead" C2c2). In an embodiment, said amino acid residues correspond to Lsh C2c2 amino acid residues, or the corresponding amino acid residues of a C2c2 protein from a different species. Devices that can facilitate these steps. In some embodiments, to reduce the size of a fusion protein of the Cas13b effector and the one or more functional domains, the C-terminus of the Cas13b effector can be truncated while still maintaining its RNA binding function. For example, at least 20 amino acids, at least 50 amino acids, at least 80 amino acids, or at least 100 amino acids, or at least 150 amino acids, or at least 200 amino acids, or at least 250 amino acids, or at least 300 amino acids, or at least 350 amino acids, or up to 120 amino acids, or up to 140 amino acids, or up to 160 amino acids, or up to 180 amino acids, or up to 200 amino acids, or up to 250 amino acids, or up to 300 amino acids, or up to 350 amino acids, or up to 400 amino acids, may be truncated at the C-terminus of the Cas13b effector. Specific examples of Cas13b truncations include C-terminal Δ984-1090, C-terminal Δ1026-1090, and C-terminal Δ1053-1090, C-terminal Δ934-1090, C-terminal Δ884-1090, C-terminal Δ834-1090, C-terminal Δ784-1090, and C-terminal Δ734-1090, wherein amino acid positions correspond to amino acid positions of *Prevotella* sp. P5-125 Cas13b protein.

The above enrichment systems may also be used to deplete a sample of certain nucleic acids. For example, guide RNAs may be designed to bind non-target RNAs to remove the non-target RNAs from the sample. In one example embodiment, the guide RNAs may be designed to bind nucleic acids that do carry a particular nucleic acid variation. For example, in a given sample a higher copy number of non-variant nucleic acids may be expected. Accordingly, the embodiments disclosed herein may be used to remove the non-variant nucleic acids from a sample, to increase the efficiency with which the detection CRISPR effector system can detect the target variant sequences in a given sample.

Amplification and/or Enhancement of Detectable Positive Signal

In certain example embodiments, further modification may be introduced that further amplify the detectable positive signal. For example, activated CRISPR effector protein collateral activation may be use to generate a secondary target or additional guide sequence, or both. In one example embodiment, the reaction solution would contain a secondary target that is spiked in at high concentration. The secondary target may be distinct from the primary target (i.e. the target for which the assay is designed to detect) and in certain instances may be common across all reaction volumes. A secondary guide sequence for the secondary target may be protected, e.g. by a secondary structural feature such as a hairpin with a RNA loop, and unable to bind the second target or the CRISPR effector protein. Cleavage of the protecting group by an activated CRISPR effector protein (i.e. after activation by formation of complex with the primary target(s) in solution) and formation of a complex with free CRISPR effector protein in solution and activation from the spiked in secondary target. In certain other example embodiments, a similar concept is used with a second guide sequence to a secondary target sequence. The secondary target sequence may be protected a structural feature or protecting group on the secondary target. Cleavage of a protecting group off the secondary target then allows additional CRISPR effector protein/second guide sequence/secondary target complex to form. In yet another example embodiment, activation of CRISPR effector protein by the primary target(s) may be used to cleave a protected or circularized primer, which is then released to perform an isothermal amplification reaction, such as those disclosed herein, on a template that encodes a secondary guide sequence, secondary target sequence, or both. Subsequent transcription of this amplified template would produce more secondary guide sequence and/or secondary target sequence, followed by additional CRISPR effector protein collateral activation.

Detection of Proteins

The systems, devices, and methods disclosed herein may also be adapted for detection of polypeptides (or other molecules) in addition to detection of nucleic acids, via incorporation of a specifically configured polypeptide detection aptamer. The polypeptide detection aptamers are distinct from the masking construct aptamers discussed above. First, the aptamers are designed to specifically bind to one or more target molecules. In one example embodiment, the target molecule is a target polypeptide. In another example embodiment, the target molecule is a target chemical compound, such as a target therapeutic molecule. Methods for designing and selecting aptamers with specificity for a given target, such as SELEX, are known in the art. In addition to specificity to a given target the aptamers are further designed to incorporate a RNA polymerase promoter binding site. In certain example embodiments, the RNA polymerase promoter is a T7 promoter. Prior to binding the aptamer binding to a target, the RNA polymerase site is not accessible or otherwise recognizable to a RNA polymerase. However, the aptamer is configured so that upon binding of a target the structure of the aptamer undergoes a conformational change such that the RNA polymerase promoter is then exposed. An aptamer sequence downstream of the RNA polymerase promoter acts as a template for generation of a trigger RNA oligonucleotide by a RNA polymerase. Thus, the template portion of the aptamer may further incorporate a barcode or other identifying sequence that identifies a given aptamer and its target. Guide RNAs as described above may then be designed to recognize these specific trigger oligonucleotide sequences. Binding of the guide RNAs to the trigger oligonucleotides activates the CRISPR effector proteins which proceeds to deactivate the masking constructs and generate a positive detectable signal as described previously.

Accordingly, in certain example embodiments, the methods disclosed herein comprise the additional step of distributing a sample or set of sample into a set of individual discrete volumes, each individual discrete volume comprising peptide detection aptamers, a CRISPR effector protein, one or more guide RNAs, a masking construct, and incubating the sample or set of samples under conditions sufficient to allow binding of the detection aptamers to the one or more target molecules, wherein binding of the aptamer to a corresponding target results in exposure of the RNA polymerase promoter binding site such that synthesis of a trigger RNA is initiated by the binding of a RNA polymerase to the RNA polymerase promoter binding site.

In another example embodiment, binding of the aptamer may expose a primer binding site upon binding of the aptamer to a target polypeptide. For example, the aptamer may expose a RPA primer binding site. Thus, the addition or inclusion of the primer will then feed into an amplification reaction, such as the RPA reaction outlined above.

In certain example embodiments, the aptamer may be a conformation-switching aptamer, which upon binding to the target of interest may change secondary structure and expose new regions of single-stranded DNA. In certain example embodiments, these new regions of single-stranded DNA may be used as substrates for ligation, extending the aptamers and creating longer ssDNA molecules which can be specifically detected using the embodiments disclosed herein. The aptamer design could be further combined with ternary complexes for detection of low-epitope targets, such as glucose (Yang et al. 2015: pubs.acs.org/doi/abs/10.1021/acs.analchem.5b01634). Example conformation shifting aptamers and corresponding guide RNAs (crRNAs) are shown below.

TABLE 8

| | |
|---|---|
| Thrombin aptamer | (SEQ. I.D. No. 186) |
| Thrombin ligation probe | (SEQ. I.D. No. 187) |
| Thrombin RPA forward 1 primer | (SEQ. I.D. No. 188) |
| Thrombin RPA forward 2 primer | (SEQ. I.D. No. 189) |
| Thrombin RPA reverse 1 primer | (SEQ. I.D. No. 190) |
| Thrombin crRNA 1 | (SEQ. I.D. No. 191) |
| Thrombin crRNA 2 | (SEQ. I.D. No. 192) |
| Thrombin crRNA 3 | (SEQ. I.D. No. 193) |
| PTK7 full length amplicon control | (SEQ. I.D. No. 194) |
| PTK7 aptamer | (SEQ. I.D. No. 195) |
| PTK7 ligation probe | (SEQ. I.D. No. 196) |
| PTK7 RPA forward 1 primer | (SEQ. I.D. No. 197) |
| PTK7 RPA reverse 1 primer | (SEQ. I.D. No. 198) |
| PTK7 crRNA 1 | (SEQ. I.D. No. 199) |
| PTK7 crRNA 2 | (SEQ. I.D. No. 200) |
| PTK7 crRNA 3 | (SEQ. I.D. No. 201) |

Devices

The systems described herein can be embodied on diagnostic devices. A number of substrates and configurations may be used. The devices may be capable of defining multiple individual discrete volumes within the device. As used herein an "individual discrete volume" refers to a discrete space, such as a container, receptacle, or other defined volume or space that can be defined by properties that prevent and/or inhibit migration of target molecules, for example a volume or space defined by physical properties such as walls, for example the walls of a well, tube, or a surface of a droplet, which may be impermeable or semi-permeable, or as defined by other means such as chemical, diffusion rate limited, electro-magnetic, or light illumination, or any combination thereof that can contain a a sample within a defined space. Individual discrete volumes may be identified by molecular tags, such as nucleic acid barcodes. By "diffusion rate limited" (for example diffusion defined volumes) is meant spaces that are only accessible to certain molecules or reactions because diffusion constraints effectively defining a space or volume as would be the case for two parallel laminar streams where diffusion will limit the migration of a target molecule from one stream to the other. By "chemical" defined volume or space is meant spaces where only certain target molecules can exist because of their chemical or molecular properties, such as size, where for example gel beads may exclude certain species from entering the beads but not others, such as by surface charge, matrix size or other physical property of the bead that can allow selection of species that may enter the interior of the bead. By "electro-magnetically" defined volume or space is meant spaces where the electro-magnetic properties of the target molecules or their supports such as charge or magnetic properties can be used to define certain regions in a space such as capturing magnetic particles within a magnetic field or directly on magnets. By "optically" defined volume is meant any region of space that may be defined by illuminating it with visible, ultraviolet, infrared, or other wavelengths of light such that only target molecules within the defined space or volume may be labeled. One advantage to the use of non-walled, or semipermeable discrete volumes is that some reagents, such as buffers, chemical activators, or other agents may be passed through the discrete volume, while other materials, such as target molecules, may be maintained in the discrete volume or space. Typically, a discrete volume will include a fluid medium, (for example, an aqueous solution, an oil, a buffer, and/or a media capable of supporting cell growth) suitable for labeling of the target molecule with the indexable nucleic acid identifier under conditions that permit labeling. Exemplary discrete volumes or spaces useful in the disclosed methods include droplets (for example, microfluidic droplets and/or emulsion droplets), hydrogel beads or other polymer structures (for example poly-ethylene glycol di-acrylate beads or agarose beads), tissue slides (for example, fixed formalin paraffin embedded tissue slides with particular regions, volumes, or spaces defined by chemical, optical, or physical means), microscope slides with regions defined by depositing reagents in ordered arrays or random patterns, tubes (such as, centrifuge tubes, microcentrifuge tubes, test tubes, cuvettes, conical tubes, and the like), bottles (such as glass bottles, plastic bottles, ceramic bottles, Erlenmeyer flasks, scintillation vials and the like), wells (such as wells in a plate), plates, pipettes, or pipette tips among others. In certain embodiments, the compartment is an aqueous droplet in a water-in-oil emulsion. In specific embodiments, any of the applications, methods, or systems described herein requiring exact or uniform volumes may employ the use of an acoustic liquid dispenser.

In certain example embodiments, the device comprises a flexible material substrate on which a number of spots may be defined. Flexible substrate materials suitable for use in diagnostics and biosensing are known within the art. The flexible substrate materials may be made of plant derived fibers, such as cellulosic fibers, or may be made from flexible polymers such as flexible polyester films and other polymer types. Within each defined spot, reagents of the system described herein are applied to the individual spots. Each spot may contain the same reagents except for a different guide RNA or set of guide RNAs, or where applicable, a different detection aptamer to screen for multiple targets at once. Thus, the systems and devices herein may be able to screen samples from multiple sources (e.g. multiple clinical samples from different individuals) for the presence of the same target, or a limited number of targets, or aliquots of a single sample (or multiple samples from the same source) for the presence of multiple different targets in the sample. In certain example embodiments, the elements of the systems described herein are freeze dried onto the paper or cloth substrate. Example flexible material based substrates that may be used in certain example devices are disclosed in Pardee et al *Cell.* 2016, 165(5):1255-66 and Pardee et al. *Cell.* 2014, 159(4):950-54. Suitable flexible material-based substrates for use with biological fluids, including blood are disclosed in International Patent Application Publication No. WO/2013/071301 entitled "Paper based diagnostic test" to Shevkoplyas et al. U.S. Patent Application Publication No. 2011/0111517 entitled "Paper-based microfluidic systems" to Siegel et al. and Shafiee et al "Paper and Flexible Substrates as Materials for Biosensing Platforms to Detect Multiple Biotargets" Scientific Reports 5:8719 (2015). Further flexible based materials, including those suitable for use in wearable diagnostic devices are disclosed in Wang et al. "Flexible Substrate-Based Devices for Point-of-Care Diagnostics" Cell 34(11):909-21 (2016). Further flexible based materials may include nitrocellulose, polycarbonate, methylethyl cellulose, polyvinylidene fluoride (PVDF), polystyrene, or glass (see e.g., US20120238008). In certain embodiments, discrete volumes are separated by a hydrophobic surface, such as but not limited to wax, photoresist, or solid ink.

In some embodiments, a dosimeter or badge may be provided that serves as a sensor or indicator such that the wearer is notified of exposure to certain microbes or other agents. For example, the systems described herein may be used to detect a particular pathogen. Likewise, aptamer based embodiments disclosed above may be used to detect both polypeptide as well as other agents, such as chemical agents, to which a specific aptamer may bind. Such a device may be useful for surveillance of soldiers or other military personnel, as well as clinicians, researchers, hospital staff, and the like, in order to provide information relating to exposure to potentially dangerous agents as quickly as possible, for example for biological or chemical warfare agent detection. In other embodiments, such a surveillance badge may be used for preventing exposure to dangerous microbes or pathogens in immunocompromised patients, burn patients, patients undergoing chemotherapy, children, or elderly individuals.

Samples sources that may be analyzed using the systems and devices described herein include biological samples of a subject or environmental samples. Environmental samples may include surfaces or fluids. The biological samples may include, but are not limited to, saliva, blood, plasma, sera, stool, urine, sputum, mucous, lymph, synovial fluid, spinal fluid, cerebrospinal fluid, a swab from skin or a mucosal membrane, or combination thereof. In an example embodiment, the environmental sample is taken from a solid surface, such as a surface used in the preparation of food or other sensitive compositions and materials.

In other example embodiments, the elements of the systems described herein may be place on a single use substrate, such as swab or cloth that is used to swab a surface or sample fluid. For example, the system could be used to test for the presence of a pathogen on a food by swabbing the surface of a food product, such as a fruit or vegetable. Similarly, the single use substrate may be used to swab other surfaces for detection of certain microbes or agents, such as for use in security screening. Single use substrates may also have applications in forensics, where the CRISPR systems are designed to detect, for example identifying DNA SNPs that may be used to identify a suspect, or certain tissue or cell markers to determine the type of biological matter present in a sample. Likewise, the single use substrate could be used to collect a sample from a patient—such as a saliva sample from the mouth—or a swab of the skin. In other embodiments, a sample or swab may be taken of a meat product on order to detect the presence of absence of contaminants on or within the meat product.

Near-real-time microbial diagnostics are needed for food, clinical, industrial, and other environmental settings (see e.g., Lu TK, Bowers J, and Koeris M S., Trends Biotechnol. 2013 June; 31(6):325-7). In certain embodiments, the present invention is used for rapid detection of foodborne pathogens using guide RNAs specific to a pathogen (e.g., *Campylobacter jejuni, Clostridium perfringens, Salmonella* spp., *Escherichia coli, Bacillus cereus, Listeria monocytogenes, Shigella* spp., *Staphylococcus aureus, Staphylococcal enteritis, Streptococcus, Vibrio cholerae, Vibrio parahaemolyticus, Vibrio vulnificus, Yersinia enterocolitica* and *Yersinia pseudotuberculosis, Brucella* spp., *Corynebacterium ulcerans, Coxiella burnetii,* or *Plesiomonas shigelloides*).

In certain embodiments, the device is or comprises a flow strip. For instance, a lateral flow strip allows for RNAse (e.g. C2c2) detection by color. The RNA reporter is modified to have a first molecule (such as for instance FITC) attached to the 5' end and a second molecule (such as for instance biotin) attached to the 3' end (or vice versa). The lateral flow strip is designed to have two capture lines with anti-first molecule (e.g. anti-FITC) antibodies hybridized at the first line and anti-second molecule (e.g. anti-biotin) antibodies at the second downstream line. As the reaction flows down the strip, uncleaved reporter will bind to anti-first molecule antibodies at the first capture line, while cleaved reporters will liberate the second molecule and allow second molecule binding at the second capture line. Second molecule sandwich antibodies, for instance conjugated to nanoparticles, such as gold nanoparticles, will bind any second molecule at the first or second line and result in a strong readout/signal (e.g. color). As more reporter is cleaved, more signal will accumulate at the second capture line and less signal will appear at the first line. In certain aspects, the invention relates to the use of a follow strip as described herein for detecting nucleic acids or polypeptides. In certain aspects, the invention relates to a method for detecting nucleic acids or polypeptides with a flow strip as defined herein, e.g. (lateral) flow tests or (lateral) flow immunochromatographic assays.

In certain example embodiments, the device is a microfluidic device that generates and/or merges different droplets (i.e. individual discrete volumes). For example, a first set of droplets may be formed containing samples to be screened and a second set of droplets formed containing the elements of the systems described herein. The first and second set of droplets are then merged and then diagnostic methods as described herein are carried out on the merged droplet set. Microfluidic devices disclosed herein may be silicone-based chips and may be fabricated using a variety of techniques, including, but not limited to, hot embossing, molding of elastomers, injection molding, LIGA, soft lithography, silicon fabrication and related thin film processing techniques. Suitable materials for fabricating the microfluidic devices include, but are not limited to, cyclic olefin copolymer (COC), polycarbonate, poly(dimethylsiloxane) (PDMS), and poly(methylacrylate) (PMMA). In one embodiment, soft lithography in PDMS may be used to prepare the microfluidic devices. For example, a mold may be made using photolithography which defines the location of flow channels, valves, and filters within a substrate. The substrate material is poured into a mold and allowed to set to create a stamp. The stamp is then sealed to a solid support, such as but not limited to, glass. Due to the hydrophobic nature of some polymers, such as PDMS, which absorbs some proteins and may inhibit certain biological processes, a passivating agent may be necessary (Schoffner et al. *Nucleic Acids Research*, 1996, 24:375-379). Suitable passivating agents are known in the art and include, but are not limited to, silanes, parylene, n-Dodecyl-b-D-maltoside (DDM), pluronic, Tween-20, other similar surfactants, polyethylene glycol (PEG), albumin, collagen, and other similar proteins and peptides.

In certain example embodiments, the system and/or device may be adapted for conversion to a flow-cytometry readout in or allow to all of sensitive and quantitative measurements of millions of cells in a single experiment and improve upon existing flow-based methods, such as the PrimeFlow assay. In certain example embodiments, cells may be cast in droplets containing unpolymerized gel monomer, which can then be cast into single-cell droplets suitable for analysis by flow cytometry. A detection construct comprising a fluorescent detectable label may be cast into the droplet comprising unpolymerized gel monomer. Upon polymerization of the gel monomer to form a bead within a droplet. Because gel polymerization is through free-radical formation, the fluorescent reporter becomes covalently bound to the gel. The detection construct may be further modified to comprise a linker, such as an amine. A quencher may be added post-gel formation and will bind via the linker to the reporter construct. Thus, the quencher is not bound to the gel and is free to diffuse away when the reporter is cleaved by the CRISPR effector protein. Amplification of signal in droplet may be achieved by coupling the detection construct to a hybridization chain reaction (HCR initiator) amplification. DNA/RNA hybrid hairpins may be incorporated into the gel which may comprise a hairpin loop that has a RNase sensitive domain. By protecting a strand displacement toehold within a hairpin loop that has a RNase sensitive domain, HCR initiators may be selectively deprotected following cleavage of the hairpin loop by the CRISPR effector protein. Following deprotection of HCR initiators via toehold mediated strand displacement, fluorescent HCR monomers may be washed into the gel to enable signal amplification where the initiators are deprotected.

An example of microfluidic device that may be used in the context of the invention is described in Hour et al. "Direct Detection and drug-resistance profiling of bacteremias using inertial microfluidics" Lap Chip. 15(10):2297-2307 (2016).

In systems described herein, may further be incorporated into wearable medical devices that assess biological samples, such as biological fluids, of a subject outside the clinic setting and report the outcome of the assay remotely to a central server accessible by a medical care professional. The device may include the ability to self-sample blood, such as the devices disclosed in U.S. Patent Application Publication No. 2015/0342509 entitled "Needle-free Blood Draw to Peeters et al., U.S. Patent Application Publication No. 2015/0065821 entitled "Nanoparticle Phoresis" to Andrew Conrad.

In certain example embodiments, the device may comprise individual wells, such as microplate wells. The size of the microplate wells may be the size of standard 6, 24, 96, 384, 1536, 3456, or 9600 sized wells. In certain example embodiments, the elements of the systems described herein may be freeze dried and applied to the surface of the well prior to distribution and use.

The devices disclosed herein may further comprise inlet and outlet ports, or openings, which in turn may be connected to valves, tubes, channels, chambers, and syringes and/or pumps for the introduction and extraction of fluids into and from the device. The devices may be connected to fluid flow actuators that allow directional movement of fluids within the microfluidic device. Example actuators include, but are not limited to, syringe pumps, mechanically actuated recirculating pumps, electroosmotic pumps, bulbs, bellows, diaphragms, or bubbles intended to force movement of fluids. In certain example embodiments, the devices are connected to controllers with programmable valves that work together to move fluids through the device. In certain example embodiments, the devices are connected to the controllers discussed in further detail below. The devices may be connected to flow actuators, controllers, and sample loading devices by tubing that terminates in metal pins for insertion into inlet ports on the device.

As shown herein the elements of the system are stable when freeze dried, therefore embodiments that do not require a supporting device are also contemplated, i.e. the system may be applied to any surface or fluid that will support the reactions disclosed herein and allow for detection of a positive detectable signal from that surface or solution. In addition to freeze-drying, the systems may also be stably stored and utilized in a pelletized form. Polymers useful in forming suitable pelletized forms are known in the art.

In certain embodiments, the CRISPR effector protein is bound to each discrete volume in the device. Each discrete volume may comprise a different guide RNA specific for a different target molecule. In certain embodiments, a sample is exposed to a solid substrate comprising more than one discrete volume each comprising a guide RNA specific for a target molecule. Not being bound by a theory, each guide RNA will capture its target molecule from the sample and the sample does not need to be divided into separate assays. Thus, a valuable sample may be preserved. The effector protein may be a fusion protein comprising an affinity tag. Affinity tags are well known in the art (e.g., HA tag, Myc tag, Flag tag, His tag, biotin). The effector protein may be linked to a biotin molecule and the discrete volumes may comprise streptavidin. In other embodiments, the CRISPR effector protein is bound by an antibody specific for the effector protein. Methods of binding a CRISPR enzyme has been described previously (see, e.g., US20140356867A1).

The devices disclosed herein may also include elements of point of care (POC) devices known in the art for analyzing samples by other methods. See, for example St John and Price, "Existing and Emerging Technologies for Point-of-Care Testing" (Clin Biochem Rev. 2014 August; 35(3): 155-167).

The present invention may be used with a wireless lab-on-chip (LOC) diagnostic sensor system (see e.g., U.S. Pat. No. 9,470,699 "Diagnostic radio frequency identification sensors and applications thereof"). In certain embodiments, the present invention is performed in a LOC controlled by a wireless device (e.g., a cell phone, a personal digital assistant (PDA), a tablet) and results are reported to said device.

Radio frequency identification (RFID) tag systems include an RFID tag that transmits data for reception by an RFID reader (also referred to as an interrogator). In a typical RFID system, individual objects (e.g., store merchandise) are equipped with a relatively small tag that contains a transponder. The transponder has a memory chip that is given a unique electronic product code. The RFID reader emits a signal activating the transponder within the tag through the use of a communication protocol. Accordingly, the RFID reader is capable of reading and writing data to the tag. Additionally, the RFID tag reader processes the data according to the RFID tag system application. Currently, there are passive and active type RFID tags. The passive type RFID tag does not contain an internal power source, but is powered by radio frequency signals received from the RFID reader. Alternatively, the active type RFID tag contains an internal power source that enables the active type RFID tag to possess greater transmission ranges and memory capacity. The use of a passive versus an active tag is dependent upon the particular application.

Lab-on-the chip technology is well described in the scientific literature and consists of multiple microfluidic channels, input or chemical wells. Reactions in wells can be measured using radio frequency identification (RFID) tag technology since conductive leads from RFID electronic chip can be linked directly to each of the test wells. An antenna can be printed or mounted in another layer of the electronic chip or directly on the back of the device. Furthermore, the leads, the antenna and the electronic chip can be embedded into the LOC chip, thereby preventing shorting of the electrodes or electronics. Since LOC allows complex sample separation and analyses, this technology allows LOC tests to be done independently of a complex or expensive reader. Rather a simple wireless device such as a cell phone or a PDA can be used. In one embodiment, the wireless device also controls the separation and control of the microfluidics channels for more complex LOC analyses. In one embodiment, a LED and other electronic measuring or sensing devices are included in the LOC-RFID chip. Not being bound by a theory, this technology is disposable and allows complex tests that require separation and mixing to be performed outside of a laboratory.

In preferred embodiments, the LOC may be a microfluidic device. The LOC may be a passive chip, wherein the chip is powered and controlled through a wireless device. In certain embodiments, the LOC includes a microfluidic channel for holding reagents and a channel for introducing a sample. In certain embodiments, a signal from the wireless device delivers power to the LOC and activates mixing of the sample and assay reagents. Specifically, in the case of the present invention, the system may include a masking agent, CRISPR effector protein, and guide RNAs specific for a target molecule. Upon activation of the LOC, the microfluidic device may mix the sample and assay reagents. Upon mixing, a sensor detects a signal and transmits the results to the wireless device. In certain embodiments, the unmasking agent is a conductive RNA molecule. The conductive RNA molecule may be attached to the conductive material. Conductive molecules can be conductive nanoparticles, conductive proteins, metal particles that are attached to the protein or latex or other beads that are conductive. In certain embodiments, if DNA or RNA is used then the conductive molecules can be attached directly to the matching DNA or RNA strands. The release of the conductive molecules may be detected across a sensor. The assay may be a one step process.

Since the electrical conductivity of the surface area can be measured precisely quantitative results are possible on the disposable wireless RFID electro-assays. Furthermore, the test area can be very small allowing for more tests to be done in a given area and therefore resulting in cost savings. In certain embodiments, separate sensors each associated with a different CRISPR effector protein and guide RNA immobilized to a sensor are used to detect multiple target molecules. Not being bound by a theory, activation of different sensors may be distinguished by the wireless device.

In addition to the conductive methods described herein, other methods may be used that rely on RFID or Bluetooth as the basic low cost communication and power platform for a disposable RFID assay. For example, optical means may be used to assess the presence and level of a given target molecule. In certain embodiments, an optical sensor detects unmasking of a fluorescent masking agent.

In certain embodiments, the device of the present invention may include handheld portable devices for diagnostic reading of an assay (see e.g., Vashist et al., Commercial Smartphone-Based Devices and Smart Applications for Personalized Healthcare Monitoring and Management, *Diagnostics* 2014, 4(3), 104-128; mReader from Mobile Assay; and Holomic Rapid Diagnostic Test Reader).

As noted herein, certain embodiments allow detection via colorimetric change which has certain attendant benefits when embodiments are utilized in POC situations and/or in resource poor environments where access to more complex detection equipment to readout the signal may be limited. However, portable embodiments disclosed herein may also be coupled with hand-held spectrophotometers that enable detection of signals outside the visible range. An example of a hand-held spectrophotometer device that may be used in combination with the present invention is described in Das et al. "Ultra-portable, wireless smartphone spectrophotometer for rapid, non-destructive testing of fruit ripeness." Nature Scientific Reports. 2016, 6:32504, DOI: 10.1038/srep32504. Finally, in certain embodiments utilizing quantum dot-based masking constructs, use of a hand-held UV light, or other suitable device, may be successfully used to detect a signal owing to the near complete quantum yield provided by quantum dots.

Example Methods and Assays

The low cost and adaptability of the assay platform lends itself to a number of applications including (i) general RNA/DNA/protein quantitation, (ii) rapid, multiplexed RNA/DNA and protein expression detection, and (iii) sensitive detection of target nucleic acids, peptides, and proteins in both clinical and environmental samples. Additionally, the systems disclosed herein may be adapted for detection of transcripts within biological settings, such as cells. Given the highly specific nature of the CRISPR effectors described herein, it may possible to track allelic specific expression of transcripts or disease-associated mutations in live cells.

Figure 67A:
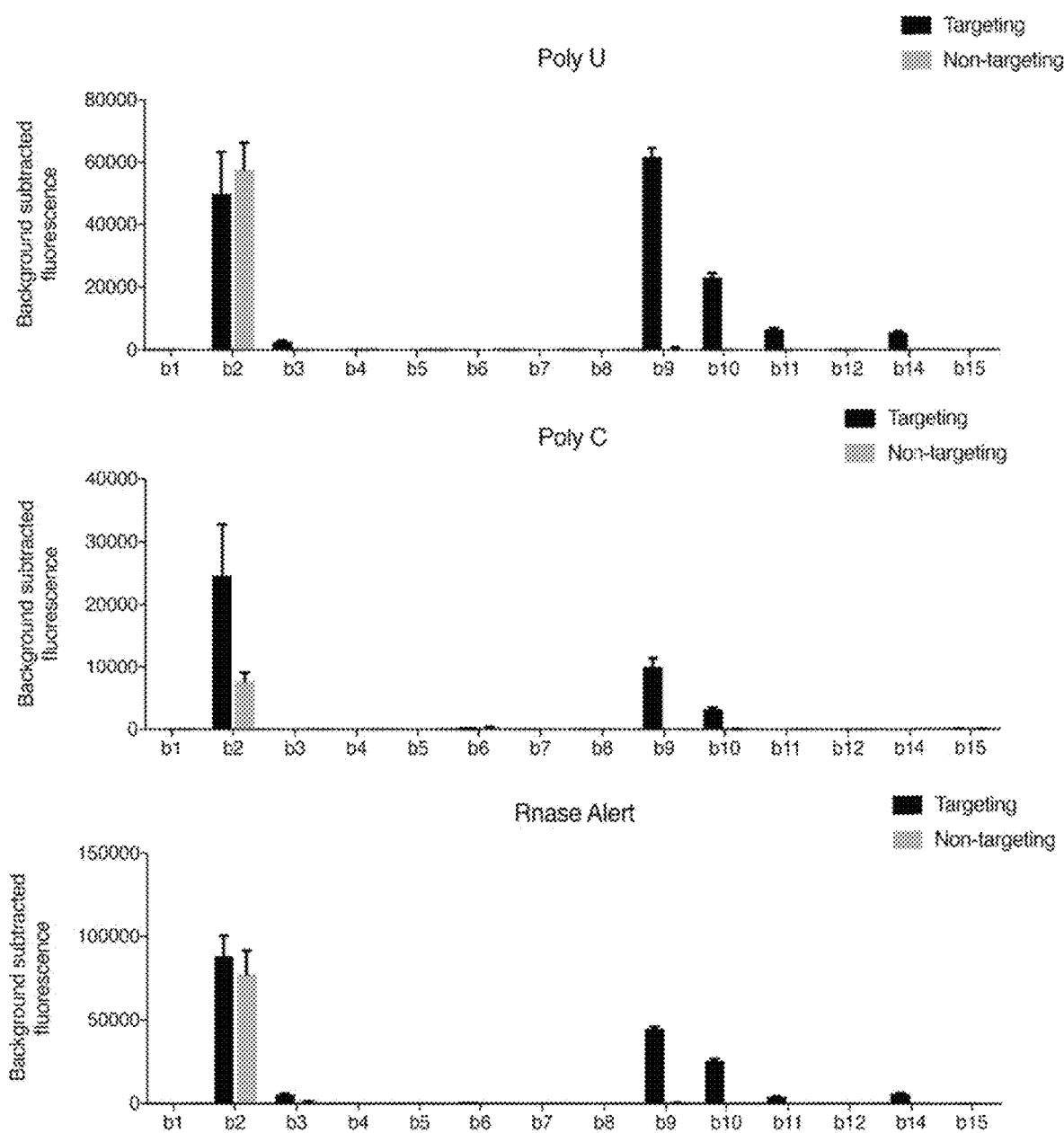
FIGS. 67A, 67B—graphs showing editing preferences of different Cas13b orthologs using (FIG. 67A) Poly U, Poly C, Rnase Alert, (FIG. 67B) Poly U, Poly A, and Poly G fluorescent sensors. See Table 3 for key.
Figure 67B:
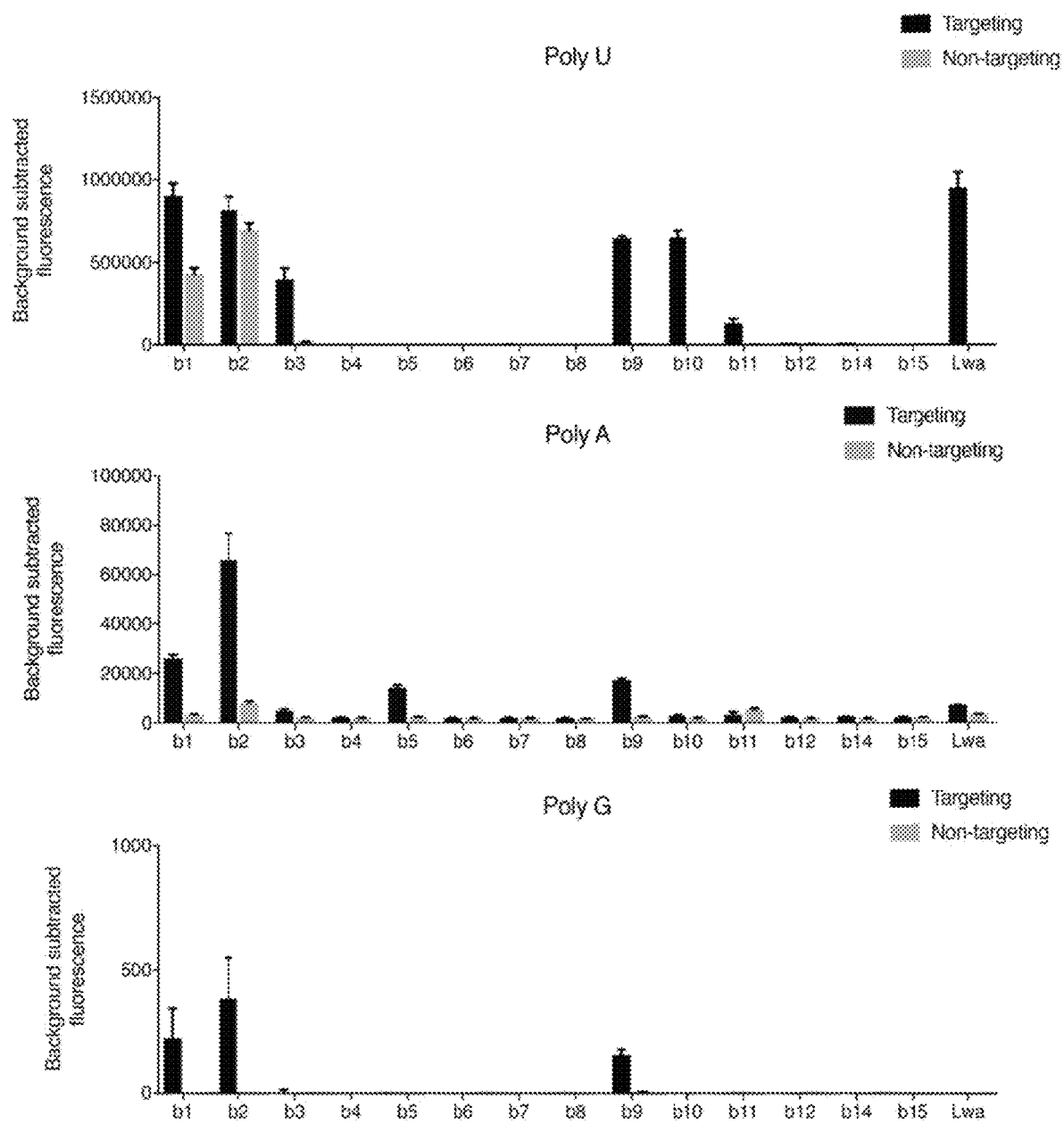
Figure 68:
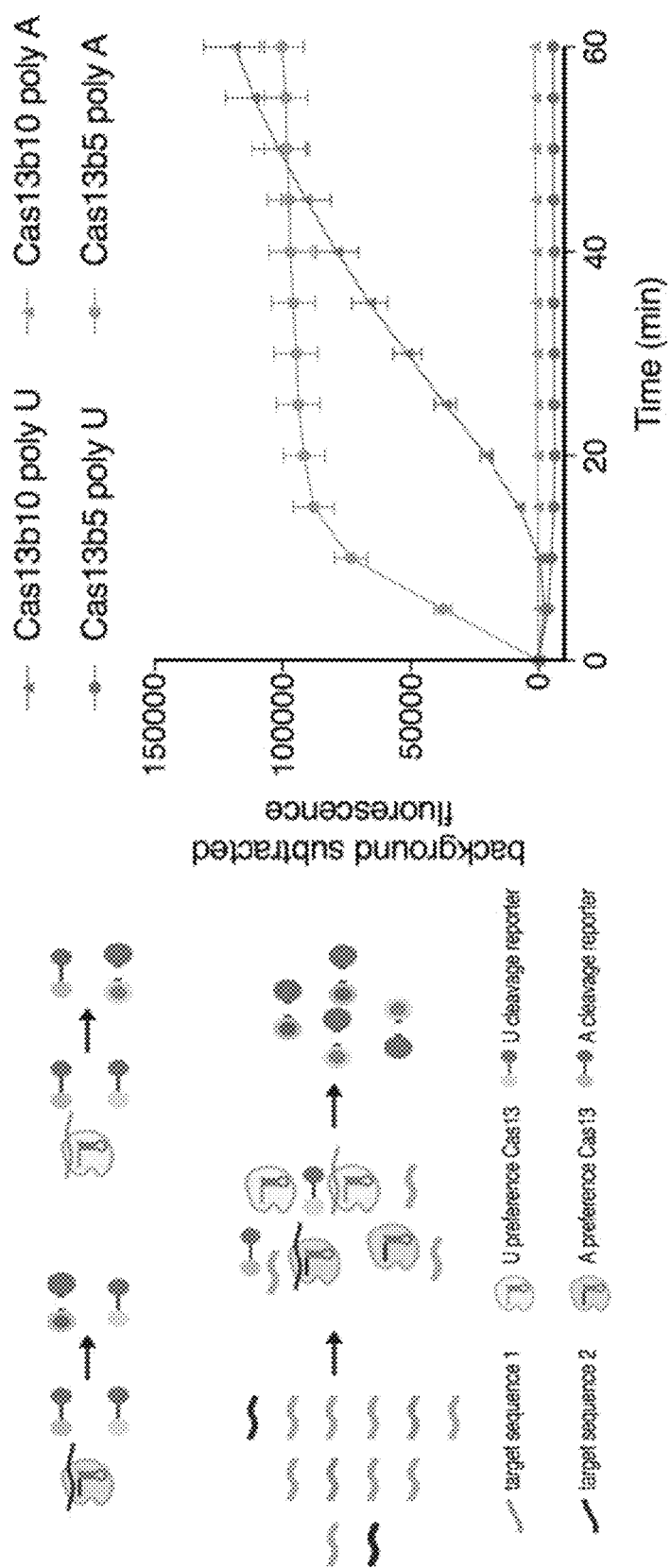
FIG. 68—The panel on the left provides a schematic of a multiplex assay using different Cas13b orthologs with different editing preferences, and the panel on the right provides data demonstrating the feasibility of such an assay using Cas13b10 and Cas13b5.
Figure 69:
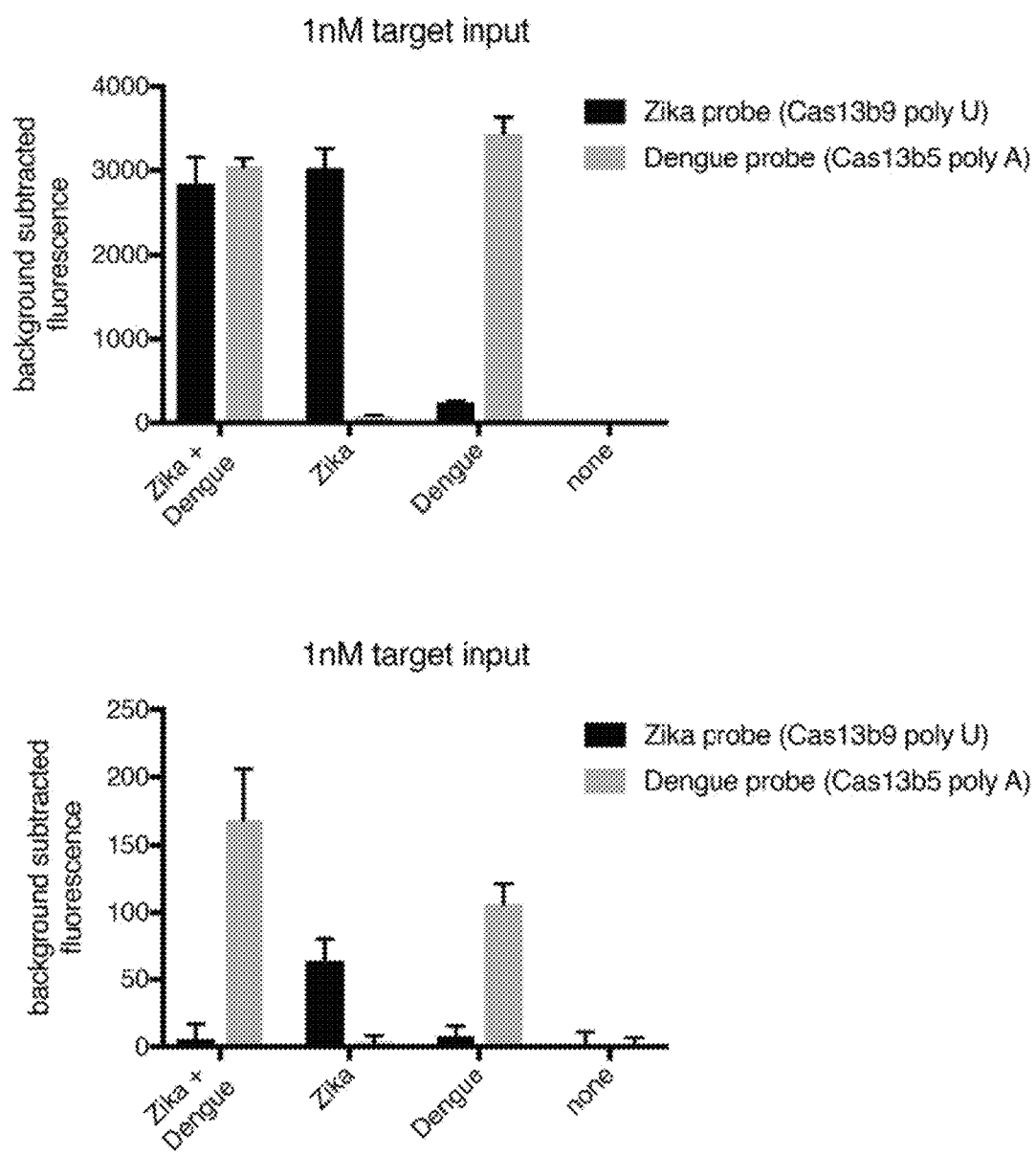
FIG. 69—provides graphs showing dual multiplexing with Cas13b5 (Prevotella sp. MA2106) and Cas13b9 (Prevotella intermedia) orthologues. Both effector proteins and guide sequences were contained in the same reaction allowing for dual multiplexing in the same reaction using different fluorescent readouts (poly U 530 nm and poly A 485 nm).
Figure 70:
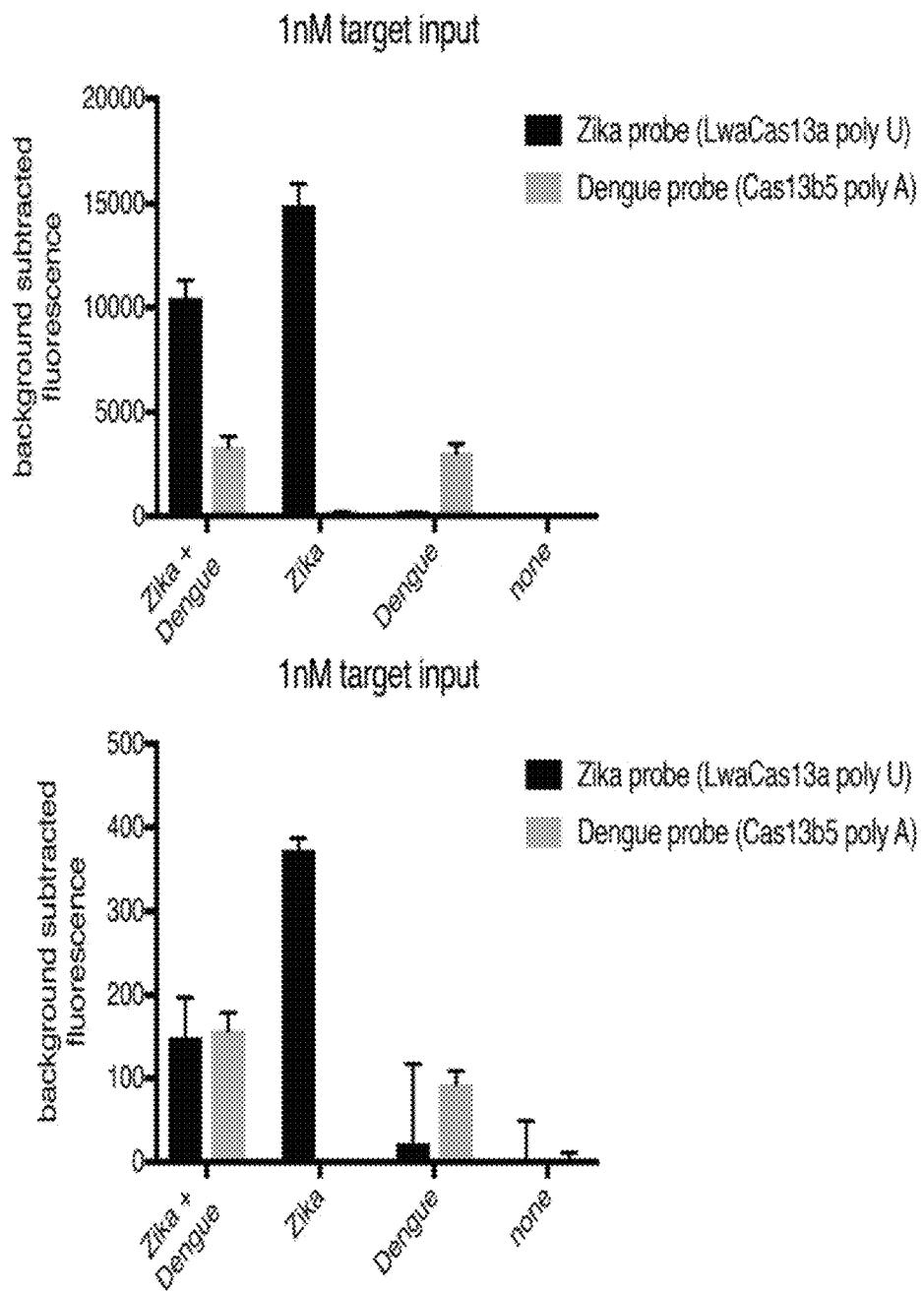
FIG. 70—provides same as FIG. 69 but in this instance using Cas13a (Leptotrichia wadei LwaCas13a) orthologs and Cas13b orthologs (Prevotella sp. MA2016, Cas13b5).
Figure 71:
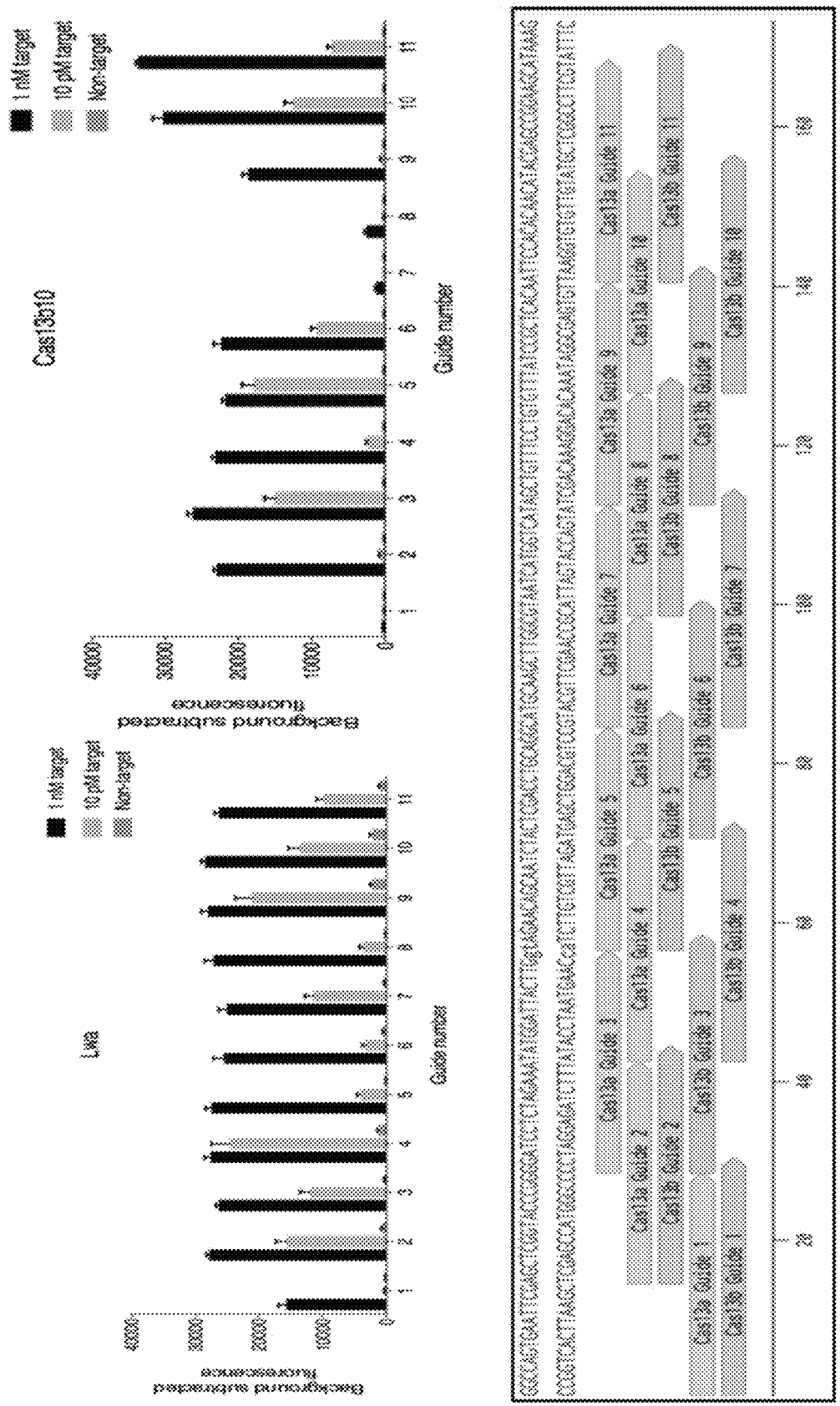
FIG. 71—provides a method for tiling target sequences with multiple guide sequences in order to determine robustness of targeting, in accordance with certain example embodiments (SEQ. I.D. Nos. 475 and 476).
Figure 72:
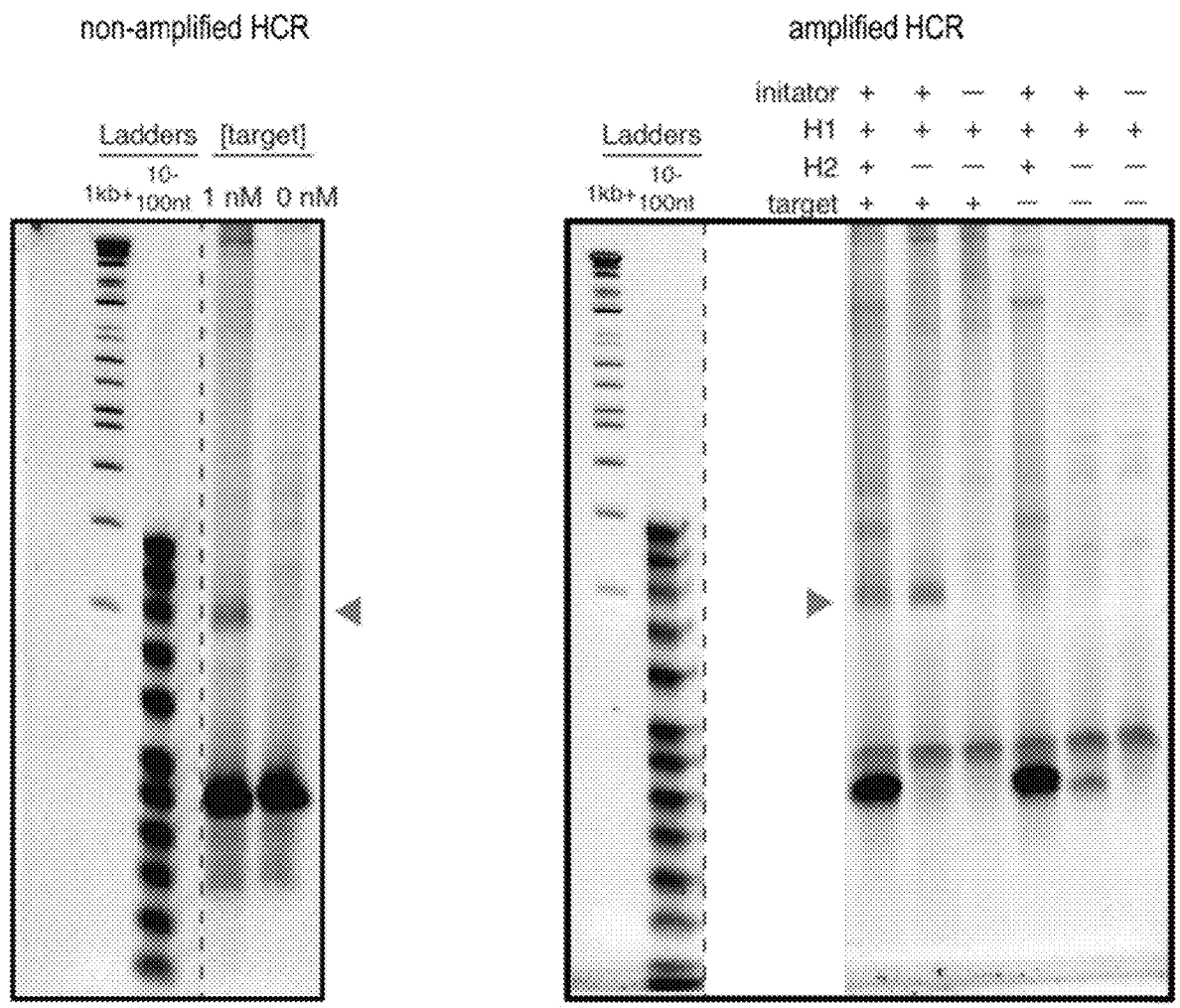
FIG. 72—provides hybrid chain reaction (HCR) gels showing that Cas13 effector proteins may be used to unlock an initiator, for an example an initiator incorporated in a masking construct as described herein, to activate a hybridization chain reaction.
Figure 73:
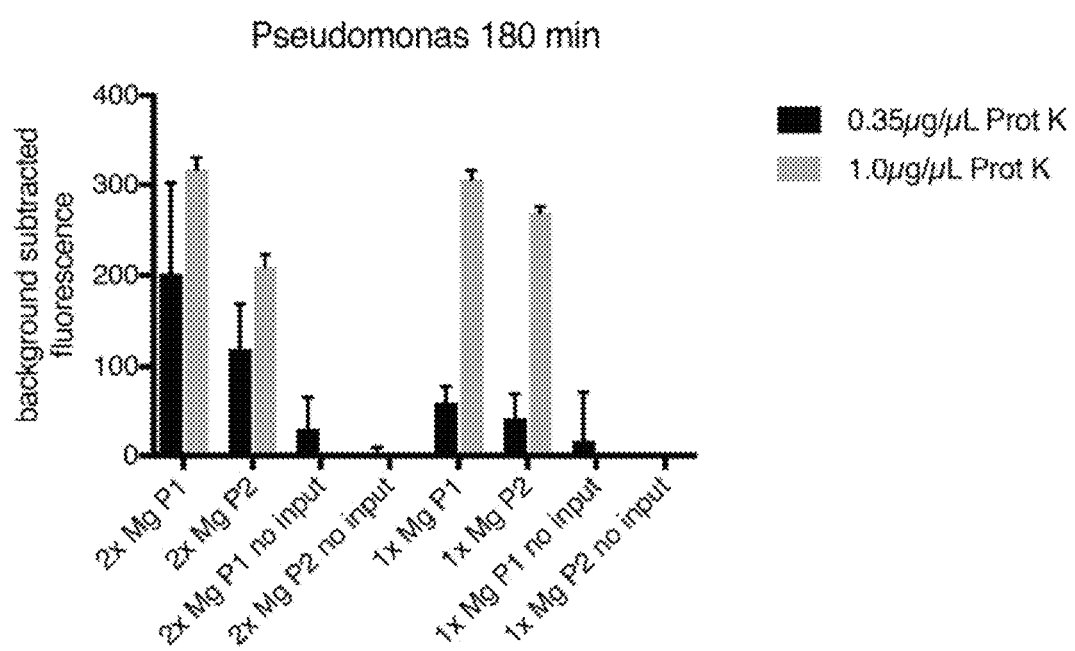
FIG. 73—provides data showing the ability to detect *Pseudomonas aeruginosa* in complex lysate.
Figure 74:
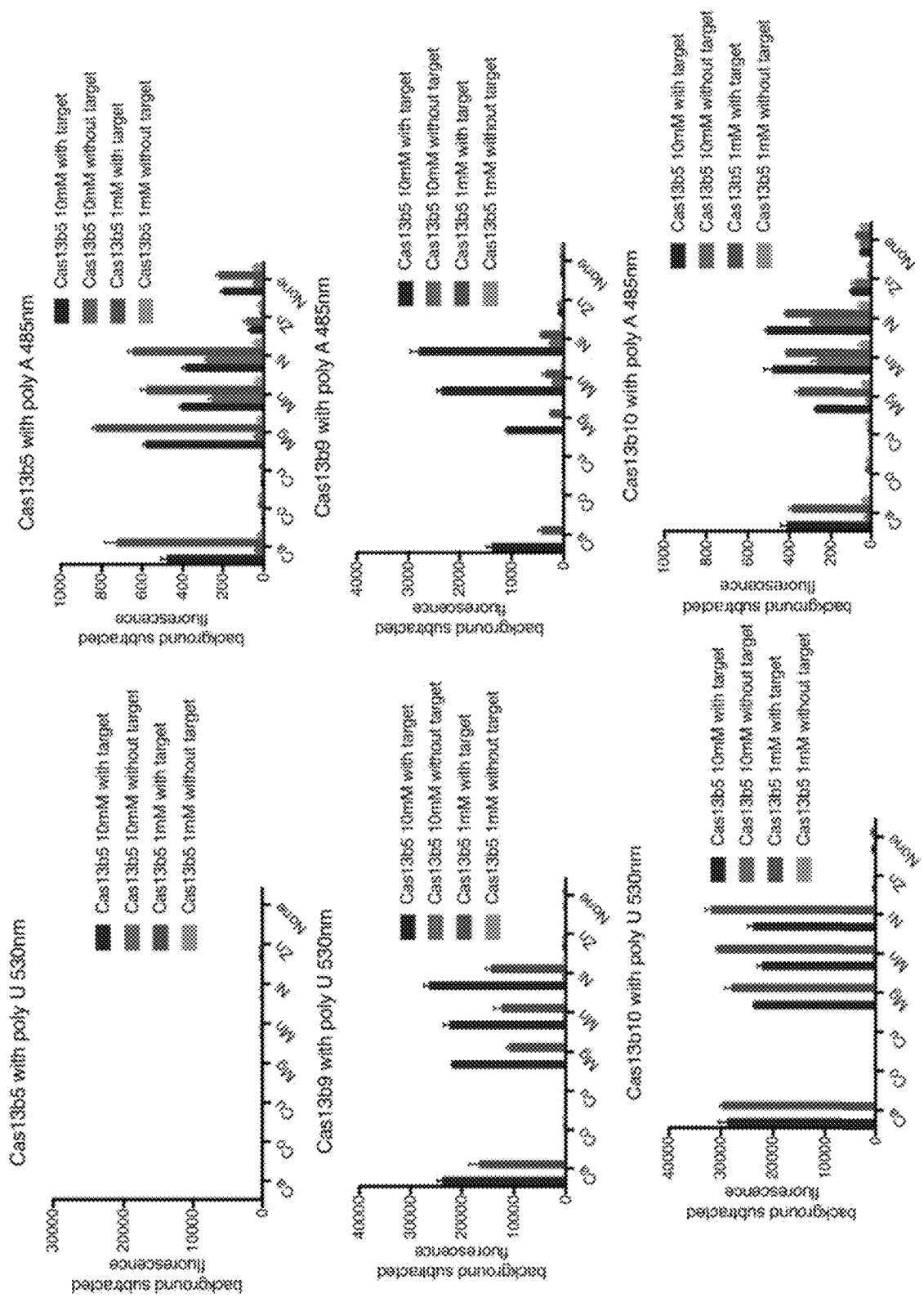
FIG. 74—provides data showing ion preferences of certain Cas13 orthologues in accordance with certain example embodiments. All target concentrations were 20 nM input with ion concentrations of (1 mM and 10 mM).
Figure 75:
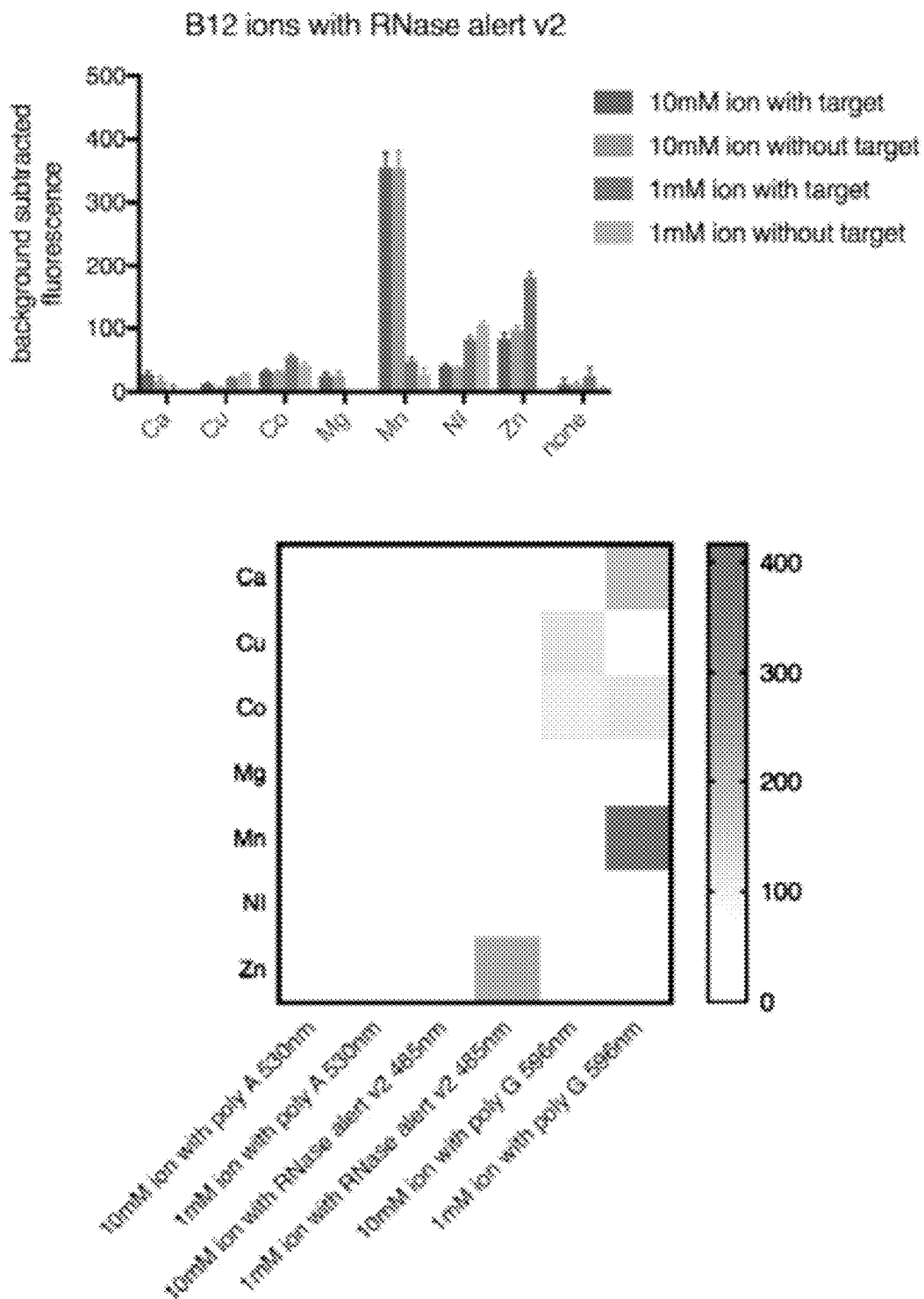
FIG. 75—provides data showing that Cas13b12 has a 1 mM Zinc sulfate preference for cleavage.
Figure 76:
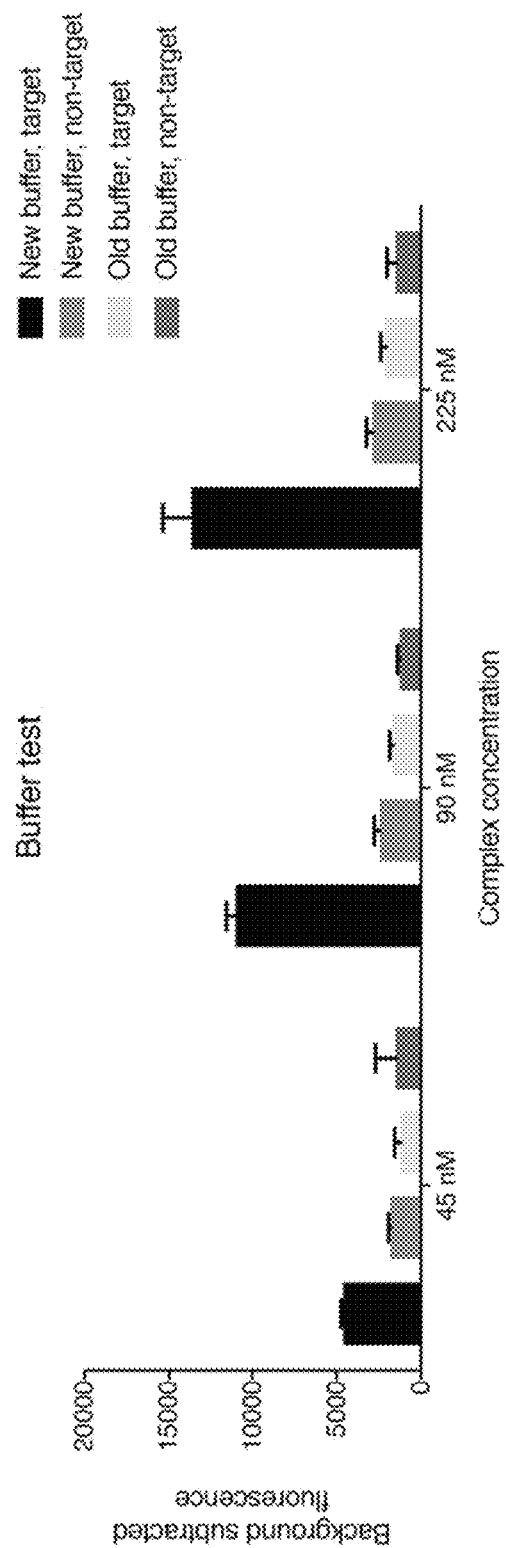
FIG. 76—provides data showing buffer optimization may boost signal to noise of Cas13b5 on a polyA reporter. Old buffer comprises 40 mM Tris-HCL, 60 mM NaCl, 6 mM MgCl2, pH 7.3. New buffer comprises 20 mM HEPES pH 6.8, 6 mM MgCl2 and 60 mM NaCl.
Figure 77:
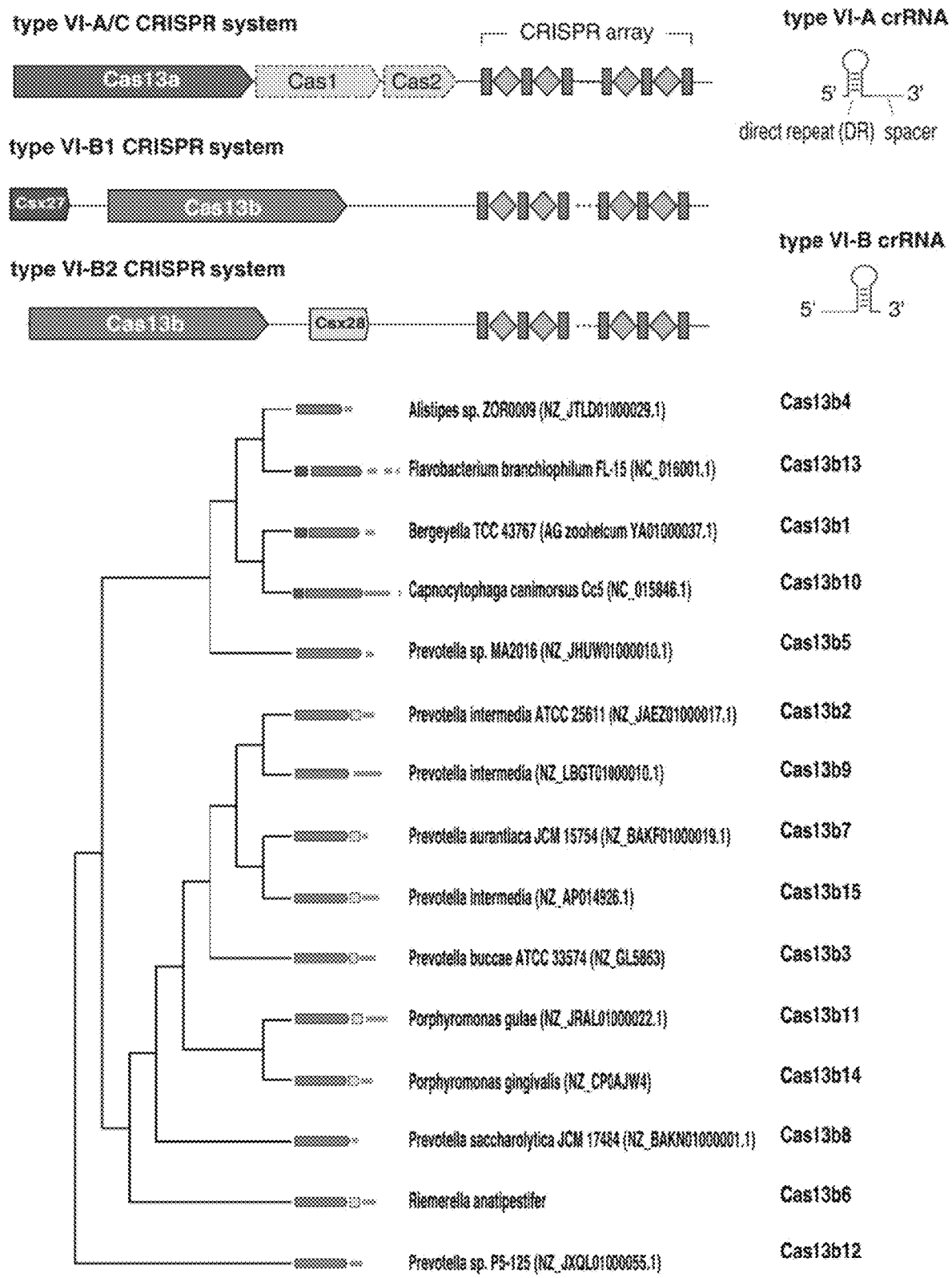
FIG. 77—provides a schematic of type VI-A/C Crispr systems and Type VI-B1 and B2 systems as well as a phylogenetic tree of representative Cas13b orthologues.
Figure 78:
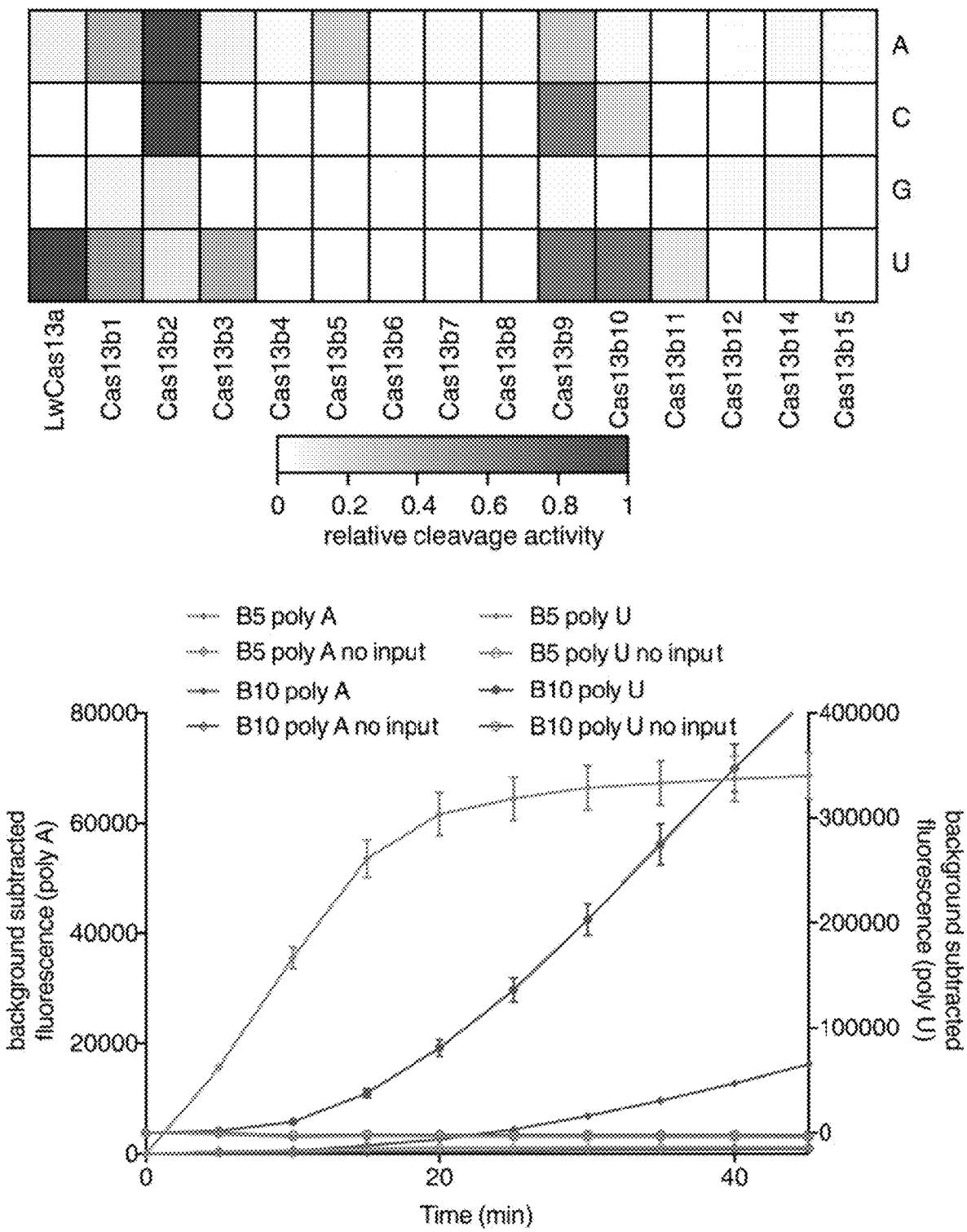
Figure 79:
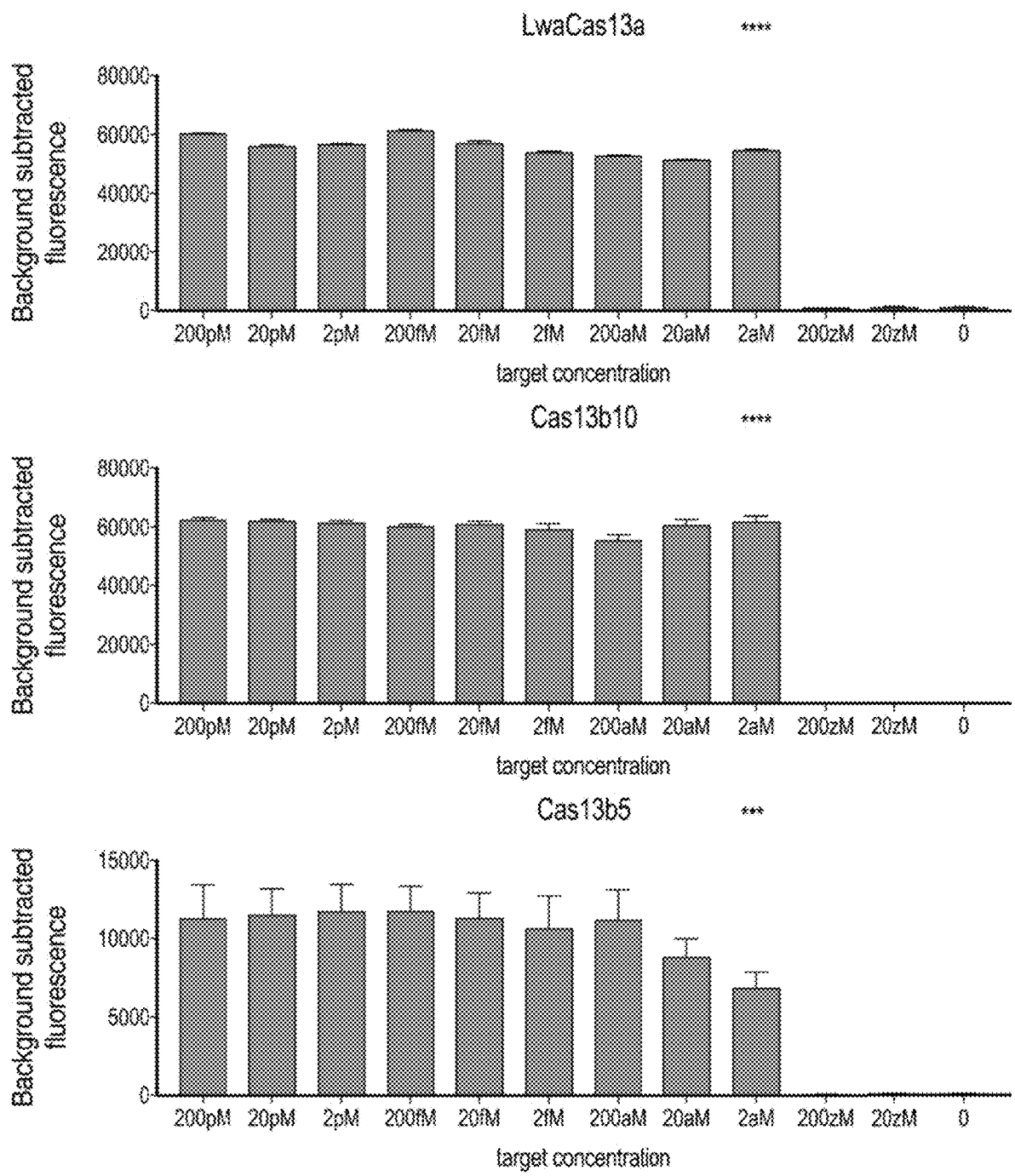
FIG. 79—provides a graph show relative sensitivity of various example Cas13 orthologs.
Figure 80:
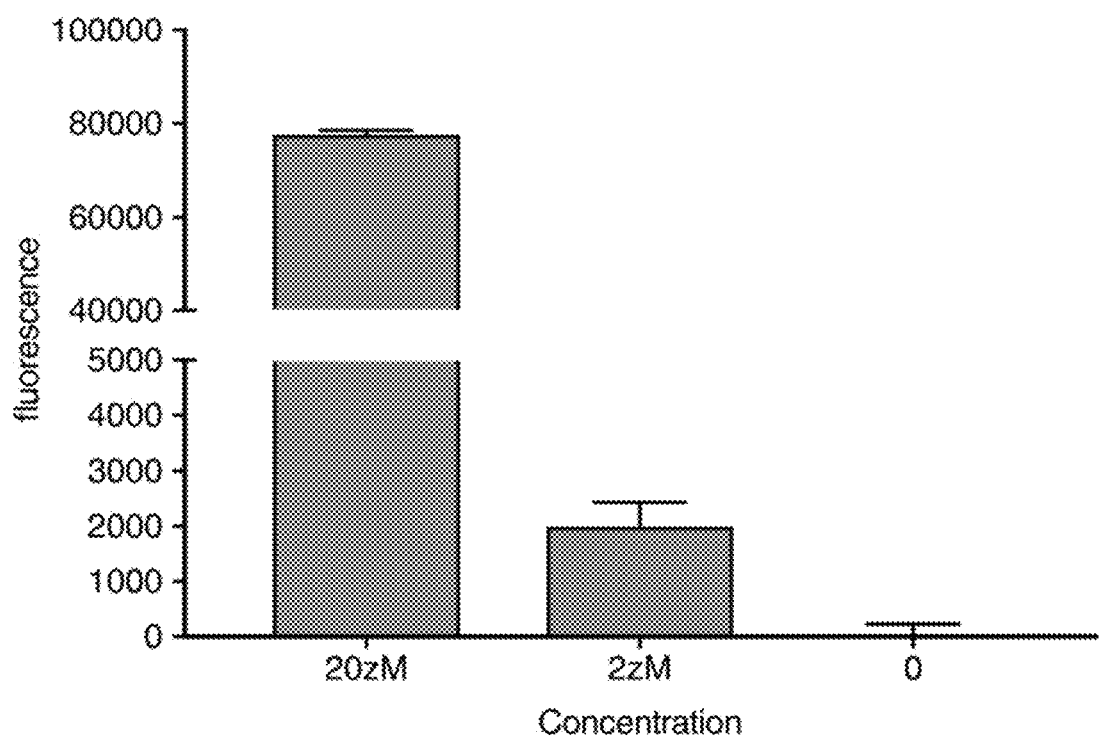
FIG. 80—provides a graph showing the ability to achieve zepto molar (zM) levels of detection using an example embodiment.
Figure 82A:
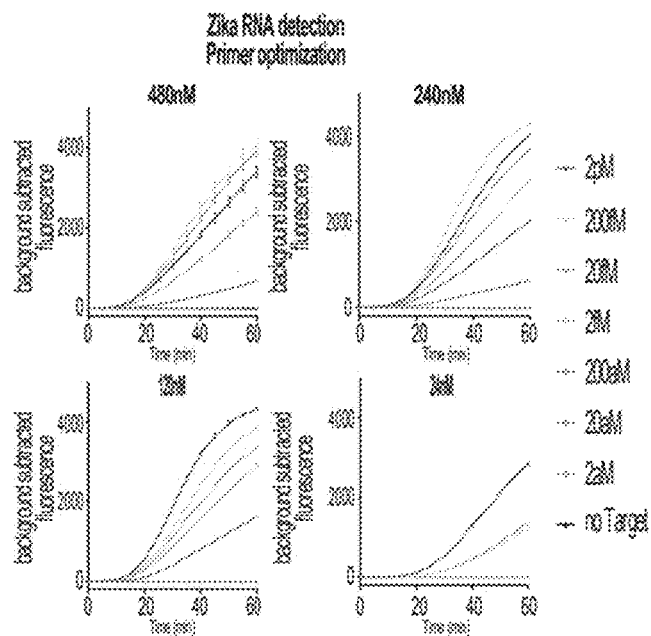
FIGS. 82A-82F provide data showing results of primer optimization experiments and detection of *Pseudomonas* over a range of conditions.
Figure 82B:
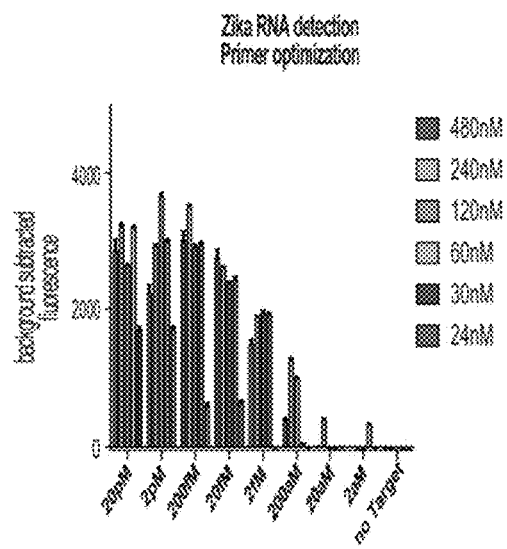
Figure 82C:
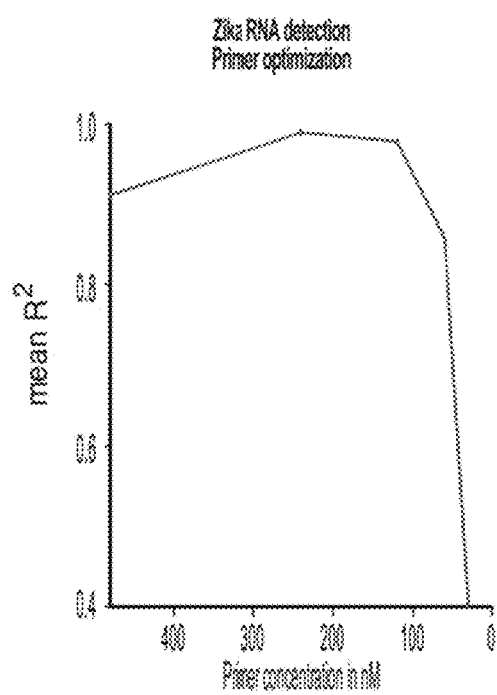
Figure 82D:
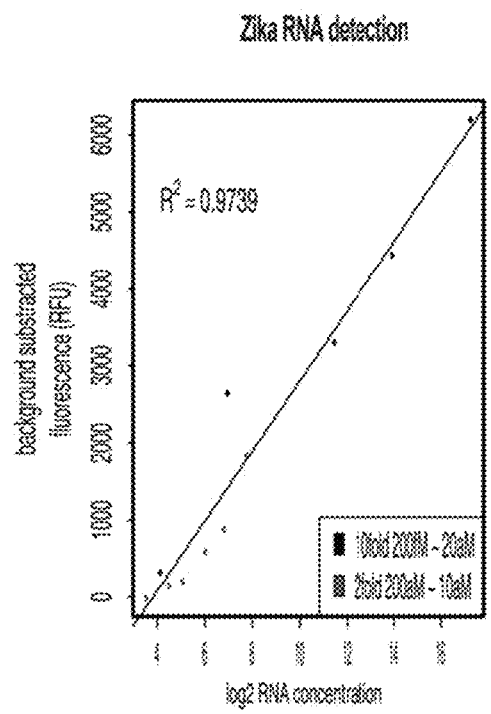
Figure 82E:
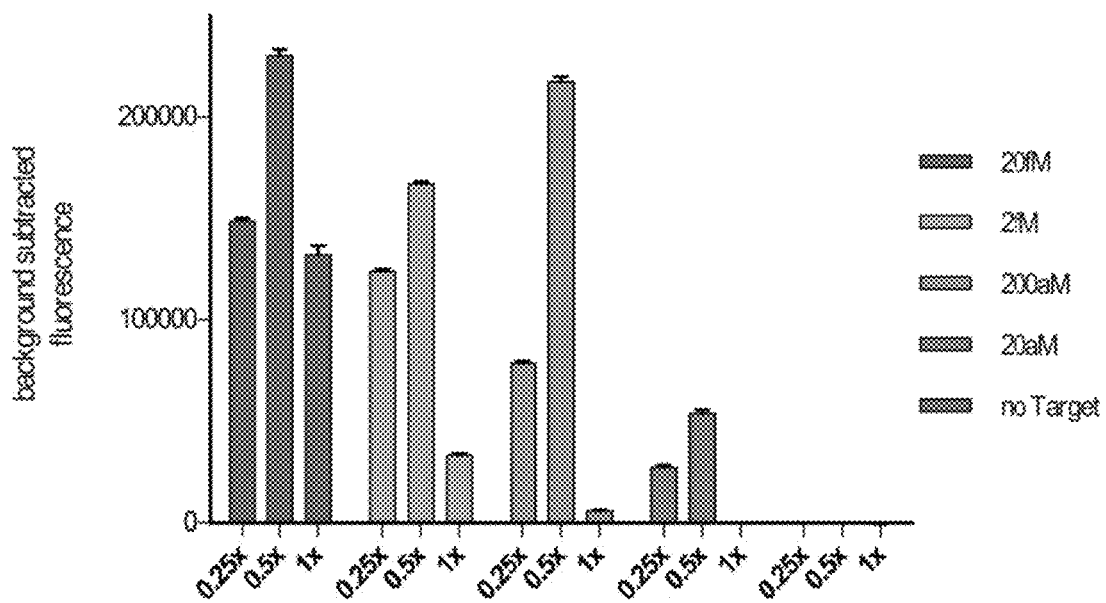
Figure 82F:
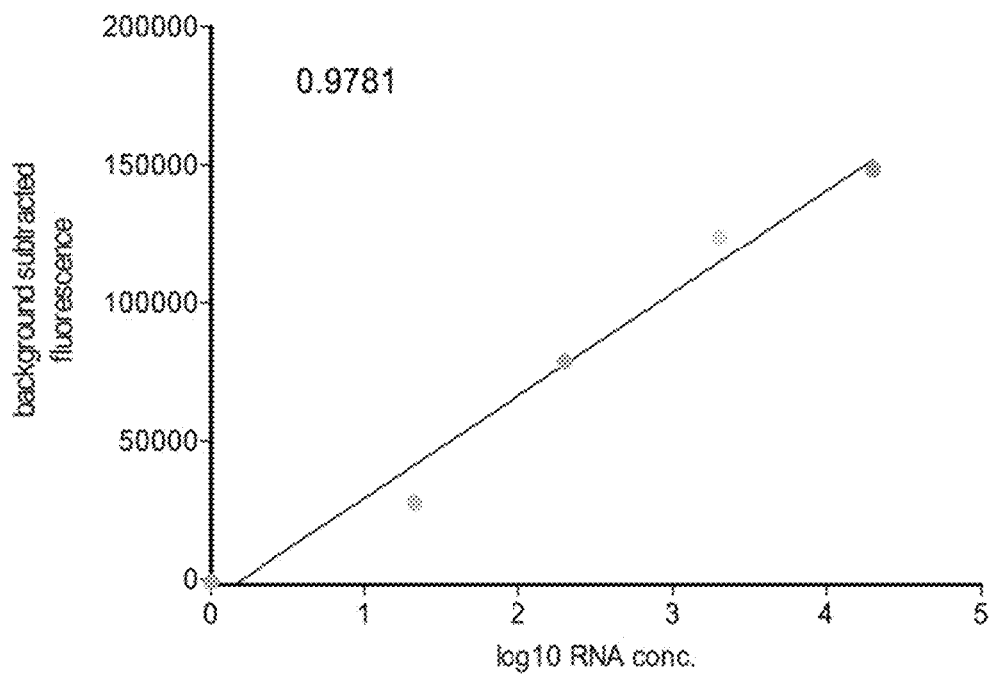

In certain example embodiments, a single guide sequences specific to a single target is placed in separate volumes. Each volume may then receive a different sample or aliquot of the same sample. In certain example embodiments, multiple guide sequences each to separate target may be placed in a single well such that multiple targets may be screened in a different well. In order to detect multiple guide RNAs in a single volume, in certain example embodiments, multiple effector proteins with different specificities may be used. For example, different orthologs with different sequence specificities may be used. For example, one orthologue may preferentially cut A, while others preferentially cut C, G, U/T. Accordingly, masking constructs completely comprising, or comprised of a substantial portion, of a single nucleotide may be generated, each with a different fluorophore that can be detected at differing wavelengths. In this way up to four different targets may be screened in a single individual discrete volume. In certain example embodiments, different orthologues from a same class of CRISPR effector protein may be used, such as two Cas13a orthologues, two Cas13b orthologues, or two Cas13c orthologues. The nucleotide preferences of various Cas13 proteins is shown in FIGS. 67A and 67B. In certain other example embodiments, different orthologues with different nucleotide editing preferences may be used such as a Cas13a and Cas13b orthologs, or a Cas13a and a Cas13c orthologs, or a Cas13b orthologs and a Cas13c orthologs etc. In certain example embodiments, a Cas13 protein with a polyU preference and a Cas13 protein with a polyA preference are used. In certain example embodiments, the Cas13 protein with a polyU preference is a *Prevotella intermedia* Cas13b and the Cas13 protein with a polyA preference is a *Prevotella* sp. MA2106 Cas13b protein (PsmCas13b). In certain example embodiments, the Cas13 protein with a polyU preference is a *Leptotrichia wadei* Cas13a (LwaCas13a) protein and the Cas13 protein with a poly A preference is a *Prevotella* sp. MA2106 Cas13b protein. In certain example embodiments, the Cas13 protein with a polyU preference is *Capnocytophaga canimorsus* Cas13b protein (CcaCas13b).

In addition to single base editing preferences. Additional detection constructs can be designed based on other motif cutting preferences of Cas 13 orthologs. For example, Cas13 orthologs may preferentially cut a dinucleotide sequence, a trinucleotide sequence or more complex motifs comprising 4, 5, 6, 7, 8, 9, or 10 nucleotide motifs. Thus the upper bound for multiplex assays using the embodiments disclosed herein is primarily limited by the number of distinguishable detectable labels. Example methods for identifying such motifs are further disclosed in the Working Examples below.

As demonstrated herein, the CRISPR effector systems are capable of detecting down to attomolar concentrations of target molecules. See e.g. FIGS. 13, 14, 19, 22 and the Working Examples described below. Due to the sensitivity of said systems, a number of applications that require rapid and sensitive detection may benefit from the embodiments disclosed herein, and are contemplated to be within the scope of the invention. Example assays and applications are described in further detail below.

Microbial Applications

In certain example embodiments, the systems, devices, and methods, disclosed herein are directed to detecting the presence of one or more microbial agents in a sample, such as a biological sample obtained from a subject. In certain example embodiments, the microbe may be a bacterium, a fungus, a yeast, a protozoa, a parasite, or a virus. Accordingly, the methods disclosed herein can be adapted for use in other methods (or in combination) with other methods that require quick identification of microbe species, monitoring the presence of microbial proteins (antigens), antibodies, antibody genes, detection of certain phenotypes (e.g. bacterial resistance), monitoring of disease progression and/or outbreak, and antibiotic screening. Because of the rapid and sensitive diagnostic capabilities of the embodiments disclosed here, detection of microbe species type, down to a single nucleotide difference, and the ability to be deployed as a POC device, the embodiments disclosed herein may be used guide therapeutic regimens, such as selection of the appropriate antibiotic or antiviral. The embodiments disclosed herein may also be used to screen environmental samples (air, water, surfaces, food etc.) for the presence of microbial contamination.

Disclosed is a method to identify microbial species, such as bacterial, viral, fungal, yeast, or parasitic species, or the like. Particular embodiments disclosed herein describe methods and systems that will identify and distinguish microbial species within a single sample, or across multiple samples, allowing for recognition of many different microbes. The present methods allow the detection of pathogens and distinguishing between two or more species of one or more organisms, e.g., bacteria, viruses, yeast, protozoa, and fungi or a combination thereof, in a biological or environmental sample, by detecting the presence of a target nucleic acid sequence in the sample. A positive signal obtained from the sample indicates the presence of the microbe. Multiple microbes can be identified simultaneously using the methods and systems of the invention, by employing the use of more than one effector protein, wherein each effector protein targets a specific microbial target sequence. In this way, a multi-level analysis can be performed for a particular subject in which any number of microbes can be detected at once. In some embodiments, simultaneous detection of multiple microbes may be performed using a set of probes that can identify one or more microbial species.

Multiplex analysis of samples enables large-scale detection of samples, reducing the time and cost of analyses. However, multiplex analyses are often limited by the availability of a biological sample. In accordance with the invention, however, alternatives to multiplex analysis may be performed such that multiple effector proteins can be added to a single sample and each masking construct may be combined with a separate quencher dye. In this case, positive signals may be obtained from each quencher dye separately for multiple detection in a single sample.

Disclosed herein are methods for distinguishing between two or more species of one or more organisms in a sample. The methods are also amenable to detecting one or more species of one or more organisms in a sample.

Microbe Detection

In some embodiments, a method for detecting microbes in samples is provided comprising distributing a sample or set of samples into one or more individual discrete volumes, the individual discrete volumes comprising a CRISPR system as described herein; incubating the sample or set of samples under conditions sufficient to allow binding of the one or more guide RNAs to one or more microbe-specific targets; activating the CRISPR effector protein via binding of the one or more guide RNAs to the one or more target molecules, wherein activating the CRISPR effector protein results in modification of the RNA-based masking construct such that a detectable positive signal is generated; and detecting the detectable positive signal, wherein detection of the detectable positive signal indicates a presence of one or more target molecules in the sample. The one or more target molecules may be mRNA, gDNA (coding or non-coding), trRNA, or rRNA comprising a target nucleotide tide sequence that may be used to distinguish two or more microbial species/strains from one another. The guide RNAs may be designed to detect target sequences. The embodiments disclosed herein may also utilize certain steps to improve hybridization between guide RNA and target RNA sequences. Methods for enhancing ribonucleic acid hybridization are disclosed in WO 2015/085194, entitled "Enhanced Methods of Ribonucleic Acid Hybridization" which is incorporated herein by reference. The microbe-specific target may be RNA or DNA or a protein. If DNA method may further comprise the use of DNA primers that introduce a RNA polymerase promoter as described herein. If the target is a protein than the method will utilized aptamers and steps specific to protein detection described herein.

Detection of Single Nucleotide Variants

In some embodiments, one or more identified target sequences may be detected using guide RNAs that are specific for and bind to the target sequence as described herein. The systems and methods of the present invention can distinguish even between single nucleotide polymorphisms present among different microbial species and therefore, use of multiple guide RNAs in accordance with the invention may further expand on or improve the number of target sequences that may be used to distinguish between species. For example, in some embodiments, the one or more guide RNAs may distinguish between microbes at the species, genus, family, order, class, phylum, kingdom, or phenotype, or a combination thereof.

Detection Based on rRNA Sequences

In certain example embodiments, the devices, systems, and methods disclosed herein may be used to distinguish multiple microbial species in a sample. In certain example embodiments, identification may be based on ribosomal RNA sequences, including the 16S, 23S, and 5S subunits. Methods for identifying relevant rRNA sequences are disclosed in U.S. Patent Application Publication No. 2017/0029872. In certain example embodiments, a set of guide RNA may designed to distinguish each species by a variable region that is unique to each species or strain. Guide RNAs may also be designed to target RNA genes that distinguish microbes at the genus, family, order, class, phylum, kingdom levels, or a combination thereof. In certain example embodiments where amplification is used, a set of amplification primers may be designed to flanking constant regions of the ribosomal RNA sequence and a guide RNA designed to distinguish each species by a variable internal region. In certain example embodiments, the primers and guide RNAs may be designed to conserved and variable regions in the 16S subunit respectfully. Other genes or genomic regions that uniquely variable across species or a subset of species such as the RecA gene family, RNA polymerase 13 subunit, may be used as well. Other suitable phylogenetic markers, and methods for identifying the same, are discussed for example in Wu et al. arXiv:1307.8690 [q-bio.GN].

In certain example embodiments, a method or diagnostic is designed to screen microbes across multiple phylogenetic and/or phenotypic levels at the same time. For example, the method or diagnostic may comprise the use of multiple CRISPR systems with different guide RNAs. A first set of guide RNAs may distinguish, for example, between mycobacteria, gram positive, and gram negative bacteria. These general classes can be even further subdivided. For example, guide RNAs could be designed and used in the method or diagnostic that distinguish enteric and non-enteric within gram negative bacteria. A second set of guide RNA can be designed to distinguish microbes at the genus or species level. Thus a matrix may be produced identifying all mycobacteria, gram positive, gram negative (further divided into enteric and non-enteric) with each genus of species of bacteria identified in a given sample that fall within one of those classes. The foregoing is for example purposes only. Other means for classifying other microbe types are also contemplated and would follow the general structure described above.

Screening for Drug Resistance

In certain example embodiments, the devices, systems and methods disclosed herein may be used to screen for microbial genes of interest, for example antibiotic and/or antiviral resistance genes. Guide RNAs may be designed to distinguish between known genes of interest. Samples, including clinical samples, may then be screened using the embodiments disclosed herein for detection of such genes. The ability to screen for drug resistance at POC would have tremendous benefit in selecting an appropriate treatment regime. In certain example embodiments, the antibiotic resistance genes are carbapenemases including KPC, NDM1, CTX-M15, OXA-48. Other antibiotic resistance genes are known and may be found for example in the Comprehensive Antibiotic Resistance Database (Jia et al. "CARD 2017: expansion and model-centric curation of the Comprehensive Antibiotic Resistance Database." Nucleic Acids Research, 45, D566-573).

Ribavirin is an effective antiviral that hits a number of RNA viruses. Several clinically important viruses have evolved ribavirin resistance including Foot and Mouth Disease Virus doi:10.1128/JVI.03594-13; polio virus (Pfeifer and Kirkegaard. PNAS, 100(12):7289-7294, 2003); and hepatitis C virus (Pfeiffer and Kirkegaard, J. Virol. 79(4): 2346-2355, 2005). A number of other persistent RNA viruses, such as hepatitis and HIV, have evolved resistance to existing antiviral drugs: hepatitis B virus (lamivudine, tenofovir, entecavir) doi:10/1002/hep22900; hepatitis C virus (telaprevir, BILN2061, ITMN-191, SCh6, boceprevir, AG-021541, ACH-806) doi:10.1002/hep.22549; and HIV (many drug resistance mutations) hivdb.standford.edu. The embodiments disclosed herein may be used to detect such variants among others.

Aside from drug resistance, there are a number of clinically relevant mutations that could be detected with the embodiments disclosed herein, such as persistent versus acute infection in LCMV (doi:10.1073/pnas.1019304108), and increased infectivity of Ebola (Diehl et al. Cell. 2016, 167(4):1088-1098.

As described herein elsewhere, closely related microbial species (e.g. having only a single nucleotide difference in a given target sequence) may be distinguished by introduction of a synthetic mismatch in the gRNA.

Set Cover Approaches

In particular embodiments, a set of guide RNAs is designed that can identify, for example, all microbial species within a defined set of microbes. In certain example embodiments, the methods for generating guide RNAs as described herein may be compared to methods disclosed in WO 2017/040316, incorporated herein by reference. As described in WO 2017040316, a set cover solution may identify the minimal number of target sequences probes or guide RNAs needed to cover an entire target sequence or set of target sequences, e.g. a set of genomic sequences. Set cover approaches have been used previously to identify primers and/or microarray probes, typically in the 20 to 50 base pair range. See, e.g. Pearson et al., cs.virginia.edu/~robins/papers/primers_dam11_final.pdf., Jabado et al. Nucleic Acids Res. 2006 34(22):6605-11, Jabado et al. Nucleic Acids Res. 2008, 36(1):e3 doi: 10.1093/nar/gkm1106, Duitama et al. Nucleic Acids Res. 2009, 37(8): 2483-2492, Phillippy et al. BMC Bioinformatics. 2009, 10:293 doi:10.1186/1471-2105-10-293. However, such approaches generally involved treating each primer/probe as k-mers and searching for exact matches or allowing for inexact matches using suffix arrays. In addition, the methods generally take a binary approach to detecting hybridization by selecting primers or probes such that each input sequence only needs to be bound by one primer or probe and the position of this binding along the sequence is irrelevant. Alternative methods may divide a target genome into pre-defined windows and effectively treat each window as a separate input sequence under the binary approach—i.e. they determine whether a given probe or guide RNA binds within each window and require that all of the windows be bound by the state of some probe or guide RNA. Effectively, these approaches treat each element of the "universe" in the set cover problem as being either an entire input sequence or a pre-defined window of an input sequence, and each element is considered "covered" if the start of a probe or guide RNA binds within the element. These approaches limit the fluidity to which different probe or guide RNA designs are allowed to cover a given target sequence.

In contrast, the embodiments disclosed herein are directed to detecting longer probe or guide RNA lengths, for example, in the range of 70 bp to 200 bp that are suitable for hybrid selection sequencing. In addition, the methods disclosed WO 2017/040316 herein may be applied to take a pan-target sequence approach capable of defining a probe or guide RNA sets that can identify and facilitate the detection sequencing of all species and/or strains sequences in a large and/or variable target sequence set. For example, the methods disclosed herein may be used to identify all variants of a given virus, or multiple different viruses in a single assay. Further, the method disclosed herein treat each element of the "universe" in the set cover problem as being a nucleotide of a target sequence, and each element is considered "covered" as long as a probe or guide RNA binds to some segment of a target genome that includes the element. These type of set cover methods may be used instead of the binary approach of previous methods, the methods disclosed in herein better model how a probe or guide RNA may hybridize to a target sequence. Rather than only asking if a given guide RNA sequence does or does not bind to a given window, such approaches may be used to detect a hybridization pattern—i.e. where a given probe or guide RNA binds to a target sequence or target sequences—and then determines from those hybridization patterns the minimum number of probes or guide RNAs needed to cover the set of target sequences to a degree sufficient to enable both enrichment from a sample and sequencing of any and all target sequences. These hybridization patterns may be determined by defining certain parameters that minimize a loss function, thereby enabling identification of minimal probe or guide RNA sets in a way that allows parameters to vary for each species, e.g. to reflect the diversity of each species, as well as in a computationally efficient manner that cannot be achieved using a straightforward application of a set cover solution, such as those previously applied in the probe or guide RNA design context.

The ability to detect multiple transcript abundances may allow for the generation of unique microbial signatures indicative of a particular phenotype. Various machine learning techniques may be used to derive the gene signatures. Accordingly, the guide RNAs of the CRISPR systems may be used to identify and/or quantitate relative levels of biomarkers defined by the gene signature in order to detect certain phenotypes. In certain example embodiments, the gene signature indicates susceptibility to an antibiotic, resistance to an antibiotic, or a combination thereof.

In one aspect of the invention, a method comprises detecting one or more pathogens. In this manner, differentiation between infection of a subject by individual microbes may be obtained. In some embodiments, such differentiation may enable detection or diagnosis by a clinician of specific diseases, for example, different variants of a disease. Preferably the pathogen sequence is a genome of the pathogen or a fragment thereof. The method further may comprise determining the evolution of the pathogen. Determining the evolution of the pathogen may comprise identification of pathogen mutations, e.g. nucleotide deletion, nucleotide insertion, nucleotide substitution. Amongst the latter, there are non-synonymous, synonymous, and noncoding substitutions. Mutations are more frequently non-synonymous during an outbreak. The method may further comprise determining the substitution rate between two pathogen sequences analyzed as described above. Whether the mutations are deleterious or even adaptive would require functional analysis, however, the rate of non-synonymous mutations suggests that continued progression of this epidemic could afford an opportunity for pathogen adaptation, underscoring the need for rapid containment. Thus, the method may further comprise assessing the risk of viral adaptation, wherein the number non-synonymous mutations is determined. (Gire, et al., Science 345, 1369, 2014).

Monitoring Microbe Outbreaks

In some embodiments, a CRISPR system or methods of use thereof as described herein may be used to determine the evolution of a pathogen outbreak. The method may comprise detecting one or more target sequences from a plurality of samples from one or more subjects, wherein the target sequence is a sequence from a microbe causing the outbreaks. Such a method may further comprise determining a pattern of pathogen transmission, or a mechanism involved in a disease outbreak caused by a pathogen.

The pattern of pathogen transmission may comprise continued new transmissions from the natural reservoir of the pathogen or subject-to-subject transmissions (e.g. human-to-human transmission) following a single transmission from the natural reservoir or a mixture of both. In one embodiment, the pathogen transmission may be bacterial or viral transmission, in such case, the target sequence is preferably a microbial genome or fragments thereof. In one embodiment, the pattern of the pathogen transmission is the early pattern of the pathogen transmission, i.e. at the beginning of the pathogen outbreak. Determining the pattern of the pathogen transmission at the beginning of the outbreak increases likelihood of stopping the outbreak at the earliest possible time thereby reducing the possibility of local and international dissemination.

Determining the pattern of the pathogen transmission may comprise detecting a pathogen sequence according to the methods described herein. Determining the pattern of the pathogen transmission may further comprise detecting shared intra-host variations of the pathogen sequence between the subjects and determining whether the shared intra-host variations show temporal patterns. Patterns in observed intrahost and interhost variation provide important insight about transmission and epidemiology (Gire, et al., 2014).

Detection of shared intra-host variations between the subjects that show temporal patterns is an indication of transmission links between subject (in particular between humans) because it can be explained by subject infection from multiple sources (superinfection), sample contamination recurring mutations (with or without balancing selection to reinforce mutations), or co-transmission of slightly divergent viruses that arose by mutation earlier in the transmission chain (Park, et al., *Cell* 161(7):1516-1526, 2015). Detection of shared intra-host variations between subjects may comprise detection of intra-host variants located at common single nucleotide polymorphism (SNP) positions. Positive detection of intra-host variants located at common (SNP) positions is indicative of superinfection and contamination as primary explanations for the intra-host variants. Superinfection and contamination can be parted on the basis of SNP frequency appearing as inter-host variants (Park, et al., 2015). Otherwise superinfection and contamination can be ruled out. In this latter case, detection of shared intra-host variations between subjects may further comprise assessing the frequencies of synonymous and nonsynonymous variants and comparing the frequency of synonymous and nonsynonymous variants to one another. A nonsynonymous mutation is a mutation that alters the amino acid of the protein, likely resulting in a biological change in the microbe that is subject to natural selection. Synonymous substitution does not alter an amino acid sequence. Equal frequency of synonymous and nonsynonymous variants is indicative of the intra-host variants evolving neutrally. If frequencies of synonymous and nonsynonymous variants are divergent, the intra-host variants are likely to be maintained by balancing selection. If frequencies of synonymous and nonsynonymous variants are low, this is indicative of recurrent mutation. If frequencies of synonymous and nonsynonymous variants are high, this is indicative of co-transmission (Park, et al., 2015).

Like Ebola virus, Lassa virus (LASV) can cause hemorrhagic fever with high case fatality rates. Andersen et al. generated a genomic catalog of almost 200 LASV sequences from clinical and rodent reservoir samples (Andersen, et al., Cell Volume 162, Issue 4, p 738-750, 13 Aug. 2015). Andersen et al. show that whereas the 2013-2015 EVD epidemic is fueled by human-to-human transmissions, LASV infections mainly result from reservoir-to-human infections. Andersen et al. elucidated the spread of LASV across West Africa and show that this migration was accompanied by changes in LASV genome abundance, fatality rates, codon adaptation, and translational efficiency. The method may further comprise phylogenetically comparing a first pathogen sequence to a second pathogen sequence, and determining whether there is a phylogenetic link between the first and second pathogen sequences. The second pathogen sequence may be an earlier reference sequence. If there is a phylogenetic link, the method may further comprise rooting the phylogeny of the first pathogen sequence to the second pathogen sequence. Thus, it is possible to construct the lineage of the first pathogen sequence. (Park, et al., 2015).

The method may further comprise determining whether the mutations are deleterious or adaptive. Deleterious mutations are indicative of transmission-impaired viruses and dead-end infections, thus normally only present in an individual subject. Mutations unique to one individual subject are those that occur on the external branches of the phylogenetic tree, whereas internal branch mutations are those present in multiple samples (i.e. in multiple subjects). Higher rate of nonsynonymous substitution is a characteristic of external branches of the phylogenetic tree (Park, et al., 2015).

In internal branches of the phylogenetic tree, selection has had more opportunity to filter out deleterious mutants. Internal branches, by definition, have produced multiple descendent lineages and are thus less likely to include mutations with fitness costs. Thus, lower rate of nonsynonymous substitution is indicative of internal branches (Park, et al., 2015).

Synonymous mutations, which likely have less impact on fitness, occurred at more comparable frequencies on internal and external branches (Park, et al., 2015).

By analyzing the sequenced target sequence, such as viral genomes, it is possible to discover the mechanisms responsible for the severity of the epidemic episode such as during the 2014 Ebola outbreak. For example, Gire et al. made a phylogenetic comparison of the genomes of the 2014 outbreak to all 20 genomes from earlier outbreaks suggests that the 2014 West African virus likely spread from central Africa within the past decade. Rooting the phylogeny using divergence from other ebolavirus genomes was problematic (6, 13). However, rooting the tree on the oldest outbreak revealed a strong correlation between sample date and root-to-tip distance, with a substitution rate of 8×10-4 per site per year (13). This suggests that the lineages of the three most recent outbreaks all diverged from a common ancestor at roughly the same time, around 2004, which supports the hypothesis that each outbreak represents an independent zoonotic event from the same genetically diverse viral population in its natural reservoir. They also found out that the 2014 EBOV outbreak might be caused by a single transmission from the natural reservoir, followed by human-to-human transmission during the outbreak. Their results also suggested that the epidemic episode in Sierra Leon might stem from the introduction of two genetically distinct viruses from Guinea around the same time (Gire, et al., 2014).

It has been also possible to determine how the Lassa virus spread out from its origin point, in particular thanks to human-to-human transmission and even retrace the history of this spread 400 years back (Andersen, et al., *Cell* 162(4): 738-50, 2015).

In relation to the work needed during the 2013-2015 EBOV outbreak and the difficulties encountered by the medical staff at the site of the outbreak, and more generally, the method of the invention makes it possible to carry out sequencing using fewer selected probes such that sequencing can be accelerated, thus shortening the time needed from sample taking to results procurement. Further, kits and systems can be designed to be usable on the field so that diagnostics of a patient can be readily performed without need to send or ship samples to another part of the country or the world.

In any method described above, sequencing the target sequence or fragment thereof may be used any of the sequencing processes described above. Further, sequencing the target sequence or fragment thereof may be a near-real-time sequencing. Sequencing the target sequence or fragment thereof may be carried out according to previously described methods (Experimental Procedures: Matranga et al., 2014; and Gire, et al., 2014). Sequencing the target sequence or fragment thereof may comprise parallel sequencing of a plurality of target sequences. Sequencing the target sequence or fragment thereof may comprise Illumina sequencing.

Analyzing the target sequence or fragment thereof that hybridizes to one or more of the selected probes may be an identifying analysis, wherein hybridization of a selected probe to the target sequence or a fragment thereof indicates the presence of the target sequence within the sample.

Currently, primary diagnostics are based on the symptoms a patient has. However, various diseases may share identical symptoms so that diagnostics rely much on statistics. For example, malaria triggers flu-like symptoms: headache, fever, shivering, joint pain, vomiting, hemolytic anemia, jaundice, hemoglobin in the urine, retinal damage, and convulsions. These symptoms are also common for septicemia, gastroenteritis, and viral diseases. Amongst the latter, Ebola hemorrhagic fever has the following symptoms fever, sore throat, muscular pain, headaches, vomiting, diarrhea, rash, decreased function of the liver and kidneys, internal and external hemorrhage.

When a patient is presented to a medical unit, for example in tropical Africa, basic diagnostics will conclude to malaria because statistically, malaria is the most probable disease within that region of Africa. The patient is consequently treated for malaria although the patient might not actually have contracted the disease and the patient ends up not being correctly treated. This lack of correct treatment can be life-threatening especially when the disease the patient contracted presents a rapid evolution. It might be too late before the medical staff realizes that the treatment given to the patient is ineffective and comes to the correct diagnostics and administers the adequate treatment to the patient.

The method of the invention provides a solution to this situation. Indeed, because the number of guide RNAs can be dramatically reduced, this makes it possible to provide on a single chip selected probes divided into groups, each group being specific to one disease, such that a plurality of diseases, e.g. viral infection, can be diagnosed at the same time. Thanks to the invention, more than 3 diseases can be diagnosed on a single chip, preferably more than 4, 5, 6, 7, 8, 9, 10, 11, 12, 13, 14, 15, 16, 17, 18, 19, 20 diseases at the same time, preferably the diseases that most commonly occur within the population of a given geographical area. Since each group of selected probes is specific to one of the diagnosed diseases, a more accurate diagnosis can be performed, thus diminishing the risk of administering the wrong treatment to the patient.

In other cases, a disease such as a viral infection may occur without any symptoms, or had caused symptoms but they faded out before the patient is presented to the medical staff. In such cases, either the patient does not seek any medical assistance or the diagnostics is complicated due to the absence of symptoms on the day of the presentation.

The present invention may also be used in concert with other methods of diagnosing disease, identifying pathogens and optimizing treatment based upon detection of nucleic acids, such as mRNA in crude, non-purified samples.

The method of the invention also provides a powerful tool to address this situation. Indeed, since a plurality of groups of selected guide RNAs, each group being specific to one of the most common diseases that occur within the population of the given area, are comprised within a single diagnostic, the medical staff only need to contact a biological sample taken from the patient with the chip. Reading the chip reveals the diseases the patient has contracted.

In some cases, the patient is presented to the medical staff for diagnostics of particular symptoms. The method of the invention makes it possible not only to identify which disease causes these symptoms but at the same time determine whether the patient suffers from another disease he was not aware of.

This information might be of utmost importance when searching for the mechanisms of an outbreak. Indeed, groups of patients with identical viruses also show temporal patterns suggesting a subject-to-subject transmission links.

Screening Microbial Genetic Perturbations

In certain example embodiments, the CRISPR systems disclosed herein may be used to screen microbial genetic perturbations. Such methods may be useful, for example to map out microbial pathways and functional networks. Microbial cells may be genetically modified and then screened under different experimental conditions. As described above, the embodiments disclosed herein can screen for multiple target molecules in a single sample, or a single target in a single individual discrete volume in a multiplex fashion. Genetically modified microbes may be modified to include a nucleic acid barcode sequence that identifies the particular genetic modification carried by a particular microbial cell or population of microbial cells. A barcode is s short sequence of nucleotides (for example, DNA, RNA, or combinations thereof) that is used as an identifier. A nucleic acid barcode may have a length of 4-100 nucleotides and be either single or double-stranded. Methods for identifying cells with barcodes are known in the art. Accordingly, guide RNAs of the CRISPR effector systems described herein may be used to detect the barcode. Detection of the positive detectable signal indicates the presence of a particular genetic modification in the sample. The methods disclosed herein may be combined with other methods for detecting complimentary genotype or phenotypic readouts indicating the effect of the genetic modification under the experimental conditions tested. Genetic modifications to be screened may include, but are not limited to a gene knock-in, a gene knock-out, inversions, translocations, transpositions, or one or more nucleotide insertions, deletions, substitutions, mutations, or addition of nucleic acids encoding an epitope with a functional consequence such as altering protein stability or detection. In a similar fashion, the methods described herein may be used in synthetic biology application to screen the functionality of specific arrangements of gene regulatory elements and gene expression modules.

In certain example embodiments, the methods may be used to screen hypomorphs. Generation of hypomorphs and their use in identifying key bacterial functional genes and identification of new antibiotic therapeutics as disclosed in PCT/US2016/060730 entitled "Multiplex High-Resolution Detection of Micro-organism Strains, Related Kits, Diagnostic Methods and Screening Assays" filed Nov. 4, 2016, which is incorporated herein by reference.

The different experimental conditions may comprise exposure of the microbial cells to different chemical agents, combinations of chemical agents, different concentrations of chemical agents or combinations of chemical agents, different durations of exposure to chemical agents or combinations of chemical agents, different physical parameters, or both. In certain example embodiments the chemical agent is an antibiotic or antiviral. Different physical parameters to be screened may include different temperatures, atmospheric pressures, different atmospheric and non-atmospheric gas concentrations, different pH levels, different culture media compositions, or a combination thereof Screening Environmental Samples The methods disclosed herein may also be used to screen environmental samples for contaminants by detecting the presence of target nucleic acid or polypeptides. For example, in some embodiments, the invention provides a method of detecting microbes, comprising: exposing a CRISPR system as described herein to a sample; activating an RNA effector protein via binding of one or more guide RNAs to one or more microbe-specific target RNAs or one or more trigger RNAs such that a detectable positive signal is produced. The positive signal can be detected and is indicative of the presence of one or more microbes in the sample. In some embodiments, the CRISPR system may be on a substrate as described herein, and the substrate may be exposed to the sample. In other embodiments, the same CRISPR system, and/or a different CRISPR system may be applied to multiple discrete locations on the substrate. In further embodiments, the different CRISPR system may detect a different microbe at each location. As described in further detail above, a substrate may be a flexible materials substrate, for example, including, but not limited to, a paper substrate, a fabric substrate, or a flexible polymer-based substrate.

In accordance with the invention, the substrate may be exposed to the sample passively, by temporarily immersing the substrate in a fluid to be sampled, by applying a fluid to be tested to the substrate, or by contacting a surface to be tested with the substrate. Any means of introducing the sample to the substrate may be used as appropriate.

As described herein, a sample for use with the invention may be a biological or environmental sample, such as a food sample (fresh fruits or vegetables, meats), a beverage sample, a paper surface, a fabric surface, a metal surface, a wood surface, a plastic surface, a soil sample, a freshwater sample, a wastewater sample, a saline water sample, exposure to atmospheric air or other gas sample, or a combination thereof. For example, household/commercial/industrial surfaces made of any materials including, but not limited to, metal, wood, plastic, rubber, or the like, may be swabbed and tested for contaminants. Soil samples may be tested for the presence of pathogenic bacteria or parasites, or other microbes, both for environmental purposes and/or for human, animal, or plant disease testing. Water samples such as freshwater samples, wastewater samples, or saline water samples can be evaluated for cleanliness and safety, and/or potability, to detect the presence of, for example, *Cryptosporidium parvum, Giardia lamblia*, or other microbial contamination. In further embodiments, a biological sample may be obtained from a source including, but not limited to, a tissue sample, saliva, blood, plasma, sera, stool, urine, sputum, mucous, lymph, synovial fluid, cerebrospinal fluid, ascites, pleural effusion, seroma, pus, or swab of skin or a mucosal membrane surface. In some particular embodiments, an environmental sample or biological samples may be crude samples and/or the one or more target molecules may not be purified or amplified from the sample prior to application of the method. Identification of microbes may be useful and/or needed for any number of applications, and thus any type of sample from any source deemed appropriate by one of skill in the art may be used in accordance with the invention.

In some embodiments, Checking for food contamination by bacteria, such as *E. coli*, in restaurants or other food providers; food surfaces; Testing water for pathogens like *Salmonella, Campylobacter*, or *E. coli*; also checking food quality for manufacturers and regulators to determine the purity of meat sources; identifying air contamination with pathogens such as *legionella*; Checking whether beer is contaminated or spoiled by pathogens like *Pediococcus* and *Lactobacillus*; contamination of pasteurized or un-pasteurized cheese by bacteria or fungi during manufacture.

A microbe in accordance with the invention may be a pathogenic microbe or a microbe that results in food or consumable product spoilage. A pathogenic microbe may be pathogenic or otherwise undesirable to humans, animals, or plants. For human or animal purposes, a microbe may cause a disease or result in illness. Animal or veterinary applications of the present invention may identify animals infected with a microbe. For example, the methods and systems of the invention may identify companion animals with pathogens including, but not limited to, kennel cough, rabies virus, and heartworms. In other embodiments, the methods and systems of the invention may be used for parentage testing for breeding purposes. A plant microbe may result in harm or disease to a plant, reduction in yield, or alter traits such as color, taste, consistency, odor, for food or consumable contamination purposes, a microbe may adversely affect the taste, odor, color, consistency or other commercial properties of the food or consumable product. In certain example embodiments, the microbe is a bacterial species. The bacteria may be a psychotroph, a coliform, a lactic acid bacteria, or a spore-forming bacterium. In certain example embodiments, the bacteria may be any bacterial species that causes disease or illness, or otherwise results in an unwanted product or trait. Bacteria in accordance with the invention may be pathogenic to humans, animals, or plants.

Sample Types

Appropriate samples for use in the methods disclosed herein include any conventional biological sample obtained from an organism or a part thereof, such as a plant, animal, bacteria, and the like. In particular embodiments, the biological sample is obtained from an animal subject, such as a human subject. A biological sample is any solid or fluid sample obtained from, excreted by or secreted by any living organism, including, without limitation, single celled organisms, such as bacteria, yeast, protozoans, and amoebas among others, multicellular organisms (such as plants or animals, including samples from a healthy or apparently healthy human subject or a human patient affected by a condition or disease to be diagnosed or investigated, such as an infection with a pathogenic microorganism, such as a pathogenic bacteria or virus). For example, a biological sample can be a biological fluid obtained from, for example, blood, plasma, serum, urine, stool, sputum, mucous, lymph fluid, synovial fluid, bile, ascites, pleural effusion, seroma, saliva, cerebrospinal fluid, aqueous or vitreous humor, or any bodily secretion, a transudate, an exudate (for example, fluid obtained from an abscess or any other site of infection or inflammation), or fluid obtained from a joint (for example, a normal joint or a joint affected by disease, such as rheumatoid arthritis, osteoarthritis, gout or septic arthritis), or a swab of skin or mucosal membrane surface.

A sample can also be a sample obtained from any organ or tissue (including a biopsy or autopsy specimen, such as a tumor biopsy) or can include a cell (whether a primary cell or cultured cell) or medium conditioned by any cell, tissue or organ. Exemplary samples include, without limitation, cells, cell lysates, blood smears, cytocentrifuge preparations, cytology smears, bodily fluids (e.g., blood, plasma, serum, saliva, sputum, urine, bronchoalveolar lavage, semen, etc.), tissue biopsies (e.g., tumor biopsies), fine-needle aspirates, and/or tissue sections (e.g., cryostat tissue sections and/or paraffin-embedded tissue sections). In other examples, the sample includes circulating tumor cells (which can be identified by cell surface markers). In particular examples, samples are used directly (e.g., fresh or frozen), or can be manipulated prior to use, for example, by fixation (e.g., using formalin) and/or embedding in wax (such as formalin-fixed paraffin-embedded (FFPE) tissue samples). It will be appreciated that any method of obtaining tissue from a subject can be utilized, and that the selection of the method used will depend upon various factors such as the type of tissue, age of the subject, or procedures available to the practitioner. Standard techniques for acquisition of such samples are available in the art. See, for example Schluger et al., *J. Exp. Med.* 176:1327-33 (1992); Bigby et al., *Am. Rev. Respir. Dis.* 133:515-18 (1986); Kovacs et al., *NEJM* 318:589-93 (1988); and Ognibene et al., *Am. Rev. Respir. Dis.* 129:929-32 (1984).

In other embodiments, a sample may be an environmental sample, such as water, soil, or a surface such as industrial or medical surface. In some embodiments, methods such as disclosed in US patent publication No. 2013/0190196 may be applied for detection of nucleic acid signatures, specifically RNA levels, directly from crude cellular samples with a high degree of sensitivity and specificity. Sequences specific to each pathogen of interest may be identified or selected by comparing the coding sequences from the pathogen of interest to all coding sequences in other organisms by BLAST software.

Several embodiments of the present disclosure involve the use of procedures and approaches known in the art to successfully fractionate clinical blood samples. See, e.g. the procedure described in Han Wei Hour et al., *Microfluidic Devices for Blood Fractionation*, Micromachines 2011, 2, 319-343; Ali Asgar S. Bhagat et al., *Dean Flow Fractionation (DFF) Isolation of Circulating Tumor Cells (CTCs)*

*from Blood*, 15<sup>th</sup> International Conference on Miniaturized Systems for Chemistry and Life Sciences, Oct. 2-6, 2011, Seattle, Wash.; and International Patent Publication No. WO2011109762, the disclosures of which are herein incorporated by reference in their entirety. Blood samples are commonly expanded in culture to increase sample size for testing purposes. In some embodiments of the present invention, blood or other biological samples may be used in methods as described herein without the need for expansion in culture.

Further, several embodiments of the present disclosure involve the use of procedures and approaches known in the art to successfully isolate pathogens from whole blood using spiral microchannel, as described in Han Wei Hour et al., Pathogen Isolation from Whole Blood Using Spiral Microchannel, Case No. 15995JR, Massachusetts Institute of Technology, manuscript in preparation, the disclosure of which is herein incorporated by reference in its entirety.

Owing to the increased sensitivity of the embodiments disclosed herein, in certain example embodiments, the assays and methods may be run on crude samples or samples where the target molecules to be detected are not further fractionated or purified from the sample.

Example Microbes

The embodiment disclosed herein may be used to detect a number of different microbes. The term microbe as used herein includes bacteria, fungus, protozoa, parasites and viruses.

Bacteria

The following provides an example list of the types of microbes that might be detected using the embodiments disclosed herein. In certain example embodiments, the microbe is a bacterium. Examples of bacteria that can be detected in accordance with the disclosed methods include without limitation any one or more of (or any combination of) *Acinetobacter baumanii, Actinobacillus* sp., *Actinomycetes, Actinomyces* sp. (such as *Actinomyces israelii* and *Actinomyces naeslundii*), *Aeromonas* sp. (such as *Aeromonas hydrophila, Aeromonas veronii biovar sobria* (*Aeromonas sobria*), and *Aeromonas caviae*), *Anaplasma phagocytophilum, Anaplasma marginale, Alcaligenes xylosoxidans, Acinetobacter baumanii, Actinobacillus actinomycetemcomitans, Bacillus* sp. (such as *Bacillus anthracis, Bacillus cereus, Bacillus subtilis, Bacillus thuringiensis,* and *Bacillus stearothermophilus*), *Bacteroides* sp. (such as *Bacteroides fragilis*), *Bartonella* sp. (such as *Bartonella bacilliformis* and *Bartonella henselae, Bifidobacterium* sp., *Bordetella* sp. (such as *Bordetella pertussis, Bordetella parapertussis,* and *Bordetella bronchiseptica*), *Borrelia* sp. (such as *Borrelia recurrentis,* and *Borrelia burgdorferi*), *Brucella* sp. (such as *Brucella abortus, Brucella canis, Brucella melitensis* and *Brucella suis*), *Burkholderia* sp. (such as *Burkholderia pseudomallei* and *Burkholderia cepacia*), *Campylobacter* sp. (such as *Campylobacter jejuni, Campylobacter coli, Campylobacter lari* and *Campylobacter fetus*), *Capnocytophaga* sp., *Cardiobacterium hominis, Chlamydia trachomatis, Chlamydophila pneumoniae, Chlamydophila psittaci, Citrobacter* sp. *Coxiella burnetii, Corynebacterium* sp. (such as, *Corynebacterium diphtheriae, Corynebacterium jeikeium* and *Corynebacterium*), *Clostridium* sp. (such as *Clostridium perfringens, Clostridium difficile, Clostridium botulinum* and *Clostridium tetani*), *Eikenella corrodens, Enterobacter* sp. (such as *Enterobacter aerogenes, Enterobacter agglomerans, Enterobacter cloacae* and *Escherichia coli,* including opportunistic *Escherichia coli,* such as enterotoxigenic *E. coli,* enteroinvasive *E. coli,* enteropathogenic *E. coli,* enterohemorrhagic *E. coli,* enteroaggregative *E. coli* and uropathogenic *E. coli*) *Enterococcus* sp. (such as *Enterococcus faecalis* and *Enterococcus faecium*) *Ehrlichia* sp. (such as *Ehrlichia chafeensis* and *Ehrlichia canis*), *Epidermophyton floccosum, Erysipelothrix rhusiopathiae, Eubacterium* sp., *Francisella tularensis, Fusobacterium nucleatum, Gardnerella vaginalis, Gemella morbillorum, Haemophilus* sp. (such as *Haemophilus influenzae, Haemophilus ducreyi, Haemophilus aegyptius, Haemophilus parainfluenzae, Haemophilus haemolyticus* and *Haemophilus parahaemolyticus, Helicobacter* sp. (such as *Helicobacter pylori, Helicobacter cinaedi* and *Helicobacter fennelliae*), *Kingella kingae, Klebsiella* sp. (such as *Klebsiella pneumoniae, Klebsiella granulomatis* and *Klebsiella oxytoca*), *Lactobacillus* sp., *Listeria monocytogenes, Leptospira interrogans, Legionella pneumophila, Leptospira interrogans, Peptostreptococcus* sp., *Mannheimia hemolytica, Microsporum canis, Moraxella catarrhalis, Morganella* sp., *Mobiluncus* sp., *Micrococcus* sp., *Mycobacterium* sp. (such as *Mycobacterium leprae, Mycobacterium tuberculosis, Mycobacterium paratuberculosis, Mycobacterium intracellulare, Mycobacterium avium, Mycobacterium bovis,* and *Mycobacterium marinum*), *Mycoplasma* sp. (such as *Mycoplasma pneumoniae, Mycoplasma hominis,* and *Mycoplasma genitalium*), *Nocardia* sp. (such as *Nocardia asteroides, Nocardia cyriacigeorgica* and *Nocardia brasiliensis*), *Neisseria* sp. (such as *Neisseria gonorrhoeae* and *Neisseria meningitidis*), *Pasteurella multocida, Pityrosporum orbiculare* (*Malassezia furfur*), *Plesiomonas shigelloides. Prevotella* sp., *Porphyromonas* sp., *Prevotella melaninogenica, Proteus* sp. (such as *Proteus vulgaris* and *Proteus mirabilis*), *Providencia* sp. (such as *Providencia alcalifaciens, Providencia rettgeri* and *Providencia stuartii*), *Pseudomonas aeruginosa, Propionibacterium acnes, Rhodococcus equi, Rickettsia* sp. (such as *Rickettsia rickettsii, Rickettsia akari* and *Rickettsia prowazekii, Orientia tsutsugamushi* (formerly: *Rickettsia tsutsugamushi*) and *Rickettsia typhi*), *Rhodococcus* sp., *Serratia marcescens, Stenotrophomonas maltophilia, Salmonella* sp. (such as *Salmonella enterica, Salmonella typhi, Salmonella paratyphi, Salmonella enteritidis, Salmonella cholerasuis* and *Salmonella typhimurium*), *Serratia* sp. (such as *Serratia marcescens* and *Serratia liquifaciens*), *Shigella* sp. (such as *Shigella dysenteriae, Shigella flexneri, Shigella boydii* and *Shigella sonnei*), *Staphylococcus* sp. (such as *Staphylococcus aureus, Staphylococcus epidermidis, Staphylococcus hemolyticus, Staphylococcus saprophyticus*), *Streptococcus* sp. (such as *Streptococcus pneumoniae* (for example chloramphenicol-resistant serotype 4 *Streptococcus pneumoniae,* spectinomycin-resistant serotype 6B *Streptococcus pneumoniae,* streptomycin-resistant serotype 9V *Streptococcus pneumoniae,* erythromycin-resistant serotype 14 *Streptococcus pneumoniae,* optochin-resistant serotype 14 Streptococcus pneumoniae, rifampicin-resistant serotype 18C *Streptococcus pneumoniae,* tetracycline-resistant serotype 19F *Streptococcus pneumoniae,* penicillin-resistant serotype 19F *Streptococcus pneumoniae,* and trimethoprim-resistant serotype 23F *Streptococcus pneumoniae,* chloramphenicol-resistant serotype 4 Streptococcus pneumoniae, spectinomycin-resistant serotype 6B *Streptococcus pneumoniae,* streptomycin-resistant serotype 9V *Streptococcus pneumoniae,* optochin-resistant serotype 14 Streptococcus pneumoniae, rifampicin-resistant serotype 18C *Streptococcus pneumoniae,* penicillin-resistant serotype 19F *Streptococcus pneumoniae,* or trimethoprim-resistant serotype 23F *Streptococcus pneumoniae*), *Streptococcus agalactiae, Streptococcus mutans, Streptococcus pyogenes,* Group A streptococci, *Streptococcus pyogenes,* Group B streptococci,

*Streptococcus agalactiae*, Group C streptococci, *Streptococcus anginosus, Streptococcus equismillis*, Group D streptococci, *Streptococcus bovis*, Group F streptococci, and *Streptococcus anginosus* Group G streptococci), Spirillum minus, *Streptobacillus moniliformis, Treponema* sp. (such as *Treponema carateum, Treponema pertenue, Treponema pallidum* and *Treponema endemicum, Trichophyton rubrum, T. mentagrophytes, Tropheryma whippelii, Ureaplasma urealyticum, Veillonella* sp., *Vibrio* sp. (such as *Vibrio cholerae, Vibrio parahemolyticus, Vibrio vulnificus, Vibrio parahaemolyticus, Vibrio vulnificus, Vibrio alginolyticus, Vibrio mimicus, Vibrio hollisae, Vibrio fluvialis, Vibrio metschnikovii, Vibrio damsela* and *Vibrio furnissii*), *Yersinia* sp. (such as *Yersinia enterocolitica, Yersinia pestis*, and *Yersinia pseudotuberculosis*) and *Xanthomonas maltophilia* among others.

Fungi

In certain example embodiments, the microbe is a fungus or a fungal species. Examples of fungi that can be detected in accordance with the disclosed methods include without limitation any one or more of (or any combination of), *Aspergillus, Blastomyces, Candidiasis, Coddidioides, Cryptococcus neoformans, Cryptococcus gattii*, sp. *Histoplasma* sp. (such as *Histoplasma capsulatum*), *Pneumocystis* sp. (such as *Pneumocystis jirovecii*), *Stachybotrys* (such as *Stachybotrys chartarum*), *Mucormycetes, Sporothrix*, fungal that causes eye infections, fungi that cause ringworm, *Exserohilum, Cladosporium*.

In certain example embodiments, the fungus is a yeast. Examples of yeast that can be detected in accordance with disclosed methods include without limitation one or more of (or any combination of), *Aspergillus* species (such as *Aspergillus fumigatus, Aspergillus flavus* and *Aspergillus clavatus*), *Cryptococcus* sp. (such as *Cryptococcus neoformans, Cryptococcus gattii, Cryptococcus laurentii* and *Cryptococcus albidus*), a *Geotrichum* species, a *Saccharomyces* species, a *Hansenula* species, a *Candida* species (such as *Candida albicans*), a *Kluyveromyces* species, a *Debaryomyces* species, a *Pichia* species, or combination thereof. In certain example embodiments, the fungi is a mold. Example molds include, but are not limited to, a *Penicillium* species, a *Cladosporium* species, a *Byssochlamys* species, or a combination thereof.

Protozoa

In certain example embodiments, the microbe is a protozoa. Examples of protozoa that can be detected in accordance with the disclosed methods and devices include without limitation any one or more of (or any combination of), Euglenozoa, Heterolobosea, Diplomonadida, Amoebozoa, *Blastocystis*, and Apicomplexa. Example Euglenozoa include, but are not limited to, *Trypanosoma cruzi* (Chagas disease), *T. brucei gambiense, T. brucei rhodesiense, Leishmania braziliensis, L. infantum, L. mexicana, L. major, L. tropica*, and *L. donovani*. Example Heterolobosea include, but are not limited to, *Naegleria fowleri*. Example Diplomonadids include, but are not limited to, Giardia intestinalis (*G. lamblia, G. duodenalis*). Example Amoebozoa include, but are not limited to, *Acanthamoeba castellanii, Balamuthia mandrillaris, Entamoeba histolytica*. Example Blastocysts include, but are not limited to, *Blastocystis hominis*. Example Apicomplexa include, but are not limited to, *Babesia microti, Cryptosporidium parvum, Cyclospora cayetanensis, Plasmodium falciparum, P. vivax, P. ovale, P. malariae*, and *Toxoplasma gondii*.

Parasites

In certain example embodiments, the microbe is a parasite. Examples of parasites that can be detected in accordance with disclosed methods include without limitation one or more of (or any combination of), an *Onchocerca* species and a *Plasmodium* species.

Viruses

In certain example embodiments, the systems, devices, and methods, disclosed herein are directed to detecting viruses in a sample. The embodiments disclosed herein may be used to detect viral infection (e.g. of a subject or plant), or determination of a viral strain, including viral strains that differ by a single nucleotide polymorphism. The virus may be a DNA virus, a RNA virus, or a retrovirus. Non-limiting example of viruses useful with the present invention include, but are not limited to Ebola, measles, SARS, Chikungunya, hepatitis, Marburg, yellow fever, MERS, Dengue, Lassa, influenza, rhabdovirus or HIV. A hepatitis virus may include hepatitis A, hepatitis B, or hepatitis C. An influenza virus may include, for example, influenza A or influenza B. An HIV may include HIV 1 or HIV 2. In certain example embodiments, the viral sequence may be a human respiratory syncytial virus, Sudan ebola virus, Bundibugyo virus, Tai Forest ebola virus, Reston ebola virus, Achimota, Aedes flavivirus, Aguacate virus, Akabane virus, Alethinophid reptarenavirus, Allpahuayo mammarenavirus, Amapari mmarenavirus, Andes virus, Apoi virus, Aravan virus, Aroa virus, Arumwot virus, Atlantic salmon paramyxovirus, Australian bat lyssavirus, Avian bornavirus, Avian metapneumovirus, Avian paramyxoviruses, penguin or Falkland Islands Virus, BK polyomavirus, Bagaza virus, Banna virus, Bat herpesvirus, Bat sapovirus, Bear Canon mammarenavirus, Beilong virus, Betacoronavirus, Betapapillomavirus 1-6, Bhanja virus, Bokeloh bat lyssavirus, Borna disease virus, Bourbon virus, Bovine hepacivirus, Bovine parainfluenza virus 3, Bovine respiratory syncytial virus, Brazoran virus, Bunyamwera virus, Caliciviridae virus. California encephalitis virus, Candiru virus, Canine distemper virus, Canine pneumovirus, Cedar virus, Cell fusing agent virus, Cetacean morbillivirus, Chandipura virus, Chaoyang virus, Chapare mammarenavirus, Chikungunya virus, Colobus monkey papillomavirus, Colorado tick fever virus, Cowpox virus, Crimean-Congo hemorrhagic fever virus, Culex flavivirus, Cupixi mammarenavirus, Dengue virus, Dobrava-Belgrade virus, Donggang virus, Dugbe virus, Duvenhage virus, Eastern equine encephalitis virus, Entebbe bat virus, Enterovirus A-D, European bat lyssavirus 1-2, Eyach virus, Feline morbillivirus, Fer-de-Lance paramyxovirus, Fitzroy River virus, Flaviviridae virus, Flexal mammarenavirus, GB virus C, Gairo virus, Gemycircularvirus, Goose paramyxovirus SF02, Great Island virus, Guanarito mammarenavirus, Hantaan virus, Hantavirus Z10, Heartland virus, Hendra virus, Hepatitis A/B/C/E, Hepatitis delta virus, Human bocavirus, Human coronavirus, Human endogenous retrovirus K, Human enteric coronavirus, Human genital-associated circular DNA virus-1, Human herpesvirus 1-8, Human immunodeficiency virus 1/2, Human mastadenovirus A-G, Human papillomavirus, Human parainfluenza virus 1-4, Human parechovirus, Human picornaviruse, Human smacovirus, Ikoma lyssavirus, Ilheus virus, Influenza A-C, Ippy mammarenavirus, Irkut virus, J-virus, JC polyomavirus, Japanese encephalitis virus, Junin mammarenavirus, KI polyomavirus, Kadipiro virus, Kamiti River virus, Kedougou virus, Khujand virus, Kokobera virus, Kyasanur forest disease virus, Lagos bat virus, Langat virus, Lassa mammarenavirus, Latino mammarenavirus, Leopards Hill virus, Liao ning virus, Ljungan virus, Lloviu virus, Louping ill virus, Lujo mammarenavirus, Luna mammarenavirus, Lunk virus, Lymphocytic choriomeningitis mammarenavirus, Lyssavirus Ozernoe, MSSI2\.225 virus, Machupo mammarenavirus, Mamastrovirus 1, Manzanilla virus, Mapuera virus, Marburg virus, Mayaro virus, Measles virus, Menangle virus, Mercadeo virus, Merkel cell polyomavirus, Middle East respiratory syndrome coronavirus, Mobala mammarenavirus, Modoc virus, Mojiang virus, Mokola virus, Monkeypox virus, Montana myotis leukoencephalitis virus, Mopeia lassa virus reassortant 29, Mopeia mammarenavirus, Morogoro virus, Mossman virus, Mumps virus, Murine pneumonia virus, Murray Valley encephalitis virus, Nariva virus, Newcastle disease virus, Nipah virus, Norwalk virus, Norway rat hepacivirus, Ntaya virus, O'nyong-nyong virus, Oliveros mammarenavirus, Omsk hemorrhagic fever virus, Oropouche virus, Parainfluenza virus 5, Parana mammarenavirus, Parramatta River virus, Peste-des-petits-ruminants virus, Pichinde mammarenavirus, Picornaviridae virus, Pirital mammarenavirus, Piscihepevirus A, Porcine parainfluenza virus 1, porcine rubulavirus, Powassan virus, Primate T-lymphotropic virus 1-2, Primate erythroparvovirus 1, Punta Toro virus, Puumala virus, Quang Binh virus, Rabies virus, Razdan virus, Reptile bornavirus 1, Rhinovirus A-B, Rift Valley fever virus, Rinderpest virus, Rio Bravo virus, Rodent Torque Teno virus, Rodent hepacivirus, Ross River virus, Rotavirus A-I, Royal Farm virus, Rubella virus, Sabia mammarenavirus, Salem virus, Sandfly fever Naples virus, Sandfly fever Sicilian virus, Sapporo virus, Sathuperi virus, Seal anellovirus, Semliki Forest virus, Sendai virus, Seoul virus, Sepik virus, Severe acute respiratory syndrome-related coronavirus, Severe fever with thrombocytopenia syndrome virus, Shamonda virus, Shimoni bat virus, Shuni virus, Simbu virus, Simian torque teno virus, Simian virus 40-41, Sin Nombre virus, Sindbis virus, Small anellovirus, Sosuga virus, Spanish goat encephalitis virus, Spondweni virus, St. Louis encephalitis virus, Sunshine virus, TTV-like mini virus, Tacaribe mammarenavirus, Taila virus, Tamana bat virus, Tamiami mammarenavirus, Tembusu virus, Thogoto virus, Thottapalayam virus, Tick-borne encephalitis virus, Tioman virus, Togaviridae virus, Torque teno canis virus, Torque teno douroucouli virus, Torque teno felis virus, Torque teno midi virus, Torque teno sus virus, Torque teno tamarin virus, Torque teno virus, Torque teno zalophus virus, Tuhoko virus, Tula virus, Tupaia paramyxovirus, Usutu virus, Uukuniemi virus, Vaccinia virus, Variola virus, Venezuelan equine encephalitis virus, Vesicular stomatitis Indiana virus, WU Polyomavirus, Wesselsbron virus, West Caucasian bat virus, West Nile virus, Western equine encephalitis virus, Whitewater Arroyo mammarenavirus, Yellow fever virus, Yokose virus, Yug Bogdanovac virus, Zaire ebolavirus, Zika virus, or *Zygosaccharomyces bailii* virus Z viral sequence. Examples of RNA viruses that may be detected include one or more of (or any combination of) Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus. In certain example embodiments, the virus is Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

In certain example embodiments, the virus may be a plant virus selected from the group comprising Tobacco mosaic virus (TMV), Tomato spotted wilt virus (TSWV), Cucumber mosaic virus (CMV), Potato virus Y (PVY), the RT virus Cauliflower mosaic virus (CaMV), Plum pox virus (PPV), Brome mosaic virus (BMV), Potato virus X (PVX), Citrus tristeza virus (CTV), Barley yellow dwarf virus (BYDV), Potato leafroll virus (PLRV), Tomato bushy stunt virus (TBSV), rice tungro spherical virus (RTSV), rice yellow mottle virus (RYMV), rice hoja blanca virus (RHBV), maize rayado fino virus (MRFV), maize dwarf mosaic virus (MDMV), sugarcane mosaic virus (SCMV), Sweet potato feathery mottle virus (SPFMV), sweet potato sunken vein closterovirus (SPSVV), Grapevine fanleaf virus (GFLV), Grapevine virus A (GVA), Grapevine virus B (GVB), Grapevine fleck virus (GFkV), Grapevine leafroll-associated virus-1, -2, and -3, (GLRaV-1, -2, and -3), Arabis mosaic virus (ArMV), or Rupestris stem pitting-associated virus (RSPaV). In a preferred embodiment, the target RNA molecule is part of said pathogen or transcribed from a DNA molecule of said pathogen. For example, the target sequence may be comprised in the genome of an RNA virus. It is further preferred that CRISPR effector protein hydrolyzes said target RNA molecule of said pathogen in said plant if said pathogen infects or has infected said plant. It is thus preferred that the CRISPR system is capable of cleaving the target RNA molecule from the plant pathogen both when the CRISPR system (or parts needed for its completion) is applied therapeutically, i.e. after infection has occurred or prophylactically, i.e. before infection has occurred.

In certain example embodiments, the virus may be a retrovirus. Example retroviruses that may be detected using the embodiments disclosed herein include one or more of or any combination of viruses of the Genus Alpharetrovirus, Betaretrovirus, Gammaretrovirus, Deltaretrovirus, Epsilonretrovirus, Lentivirus, Spumavirus, or the Family Metaviridae, Pseudoviridae, and Retroviridae (including HIV), Hepadnaviridae (including Hepatitis B virus), and Caulimoviridae (including Cauliflower mosaic virus).

In certain example embodiments, the virus is a DNA virus. Example DNA viruses that may be detected using the embodiments disclosed herein include one or more of (or any combination of) viruses from the Family Myoviridae, Podoviridae, Siphoviridae, Alloherpesviridae, Herpesviridae (including human herpes virus, and Varicella Zoster virus), Malacoherpesviridae, Lipothrixviridae, Rudiviridae, Adenoviridae, Ampullaviridae, Ascoviridae, Asfarviridae (including African swine fever virus), Baculoviridae, Bicaudaviridae, Clavaviridae, Corticoviridae, Fuselloviridae, Globuloviridae, Guttaviridae, Hytrosaviridae, Iridoviridae, Marseilleviridae, Mimiviridae, Nudiviridae, Nimaviridae, Pandoraviridae, Papillomaviridae, Phycodnaviridae, Plasmaviridae, Polydnaviruses, Polyomaviridae (including Simian virus 40, JC virus, BK virus), Poxviridae (including Cowpox and smallpox), Sphaerolipoviridae, Tectiviridae, Turriviridae, Dinodnavirus, Salterprovirus, Rhizidovirus, among others. In some embodiments, a method of diagnosing a species-specific bacterial infection in a subject suspected of having a bacterial infection is described as obtaining a sample comprising bacterial ribosomal ribonucleic acid from the subject; contacting the sample with one or more of the probes described, and detecting hybridization between the bacterial ribosomal ribonucleic acid sequence present in the sample and the probe, wherein the detection of hybridization indicates that the subject is infected with *Escherichia coli, Klebsiella pneumoniae, Pseudomonas aeruginosa, Staphylococcus aureus, Acinetobacter baumannii, Candida albicans, Enterobacter cloacae, Enterococcus*

*faecalis, Enterococcus faecium, Proteus mirabilis, Staphylococcus agalactiae*, or *Staphylococcus maltophilia* or a combination thereof.

Malaria Detection and Monitoring

Malaria is a mosquito-borne pathology caused by *Plasmodium* parasites. The parasites are spread to people through the bites of infected female *Anopheles* mosquitoes. Five *Plasmodium* species cause malaria in humans: *Plasmodium falciparum, Plasmodium vivax, Plasmodium ovale, Plasmodium malariae*, and *Plasmodium knowlesi*. Among them, according to the World Health Organization (WHO), *Plasmodium falciparum* and *Plasmodium vivax* are responsible for the greatest threat. *P. falciparum* is the most prevalent malaria parasite on the African continent and is responsible for most malaria-related deaths globally. *P. vivax* is the dominant malaria parasite in most countries outside of sub-Saharan Africa.

In 2015, 91 countries and areas had ongoing malaria transmission. According to the latest WHO estimates, there were 212 million cases of malaria in 2015 and 429 000 deaths. In areas with high transmission of malaria, children under 5 are particularly susceptible to infection, illness and death; more than two thirds (70%) of all malaria deaths occur in this age group. Between 2010 and 2015, the under-5 malaria death rate fell by 29% globally. However malaria remains a major killer of children under five years old, taking the life of a child every two minutes.

As described by the WHO, malaria is an acute febrile illness. In a non-immune individual, symptoms appear 7 days or more after the infective mosquito bite. The first symptoms—fever, headache, chills and vomiting—may be mild and difficult to recognize as malaria, however, if not treated within 24 hours, *P. falciparum* malaria can progress to severe illness, often leading to death.

Children with severe malaria frequently develop one or more of the following symptoms: severe anemia, respiratory distress in relation to metabolic acidosis, or cerebral malaria. In adults, multi-organ involvement is also frequent. In malaria endemic areas, people may develop partial immunity, allowing asymptomatic infections to occur.

The development of rapid and efficient diagnostic tests is of high relevance for public health. Indeed, early diagnosis and treatment of malaria not only reduces disease and prevents deaths but also contributes to reducing malaria transmission. According to the WHO recommendations, all cases of suspected malaria should be confirmed using parasite-based diagnostic testing (notably using a rapid diagnostic test) before administering treatment (see "WHO Guidelines for the treatment of malaria", third edition, published in April 2015).

Resistance to antimalarial therapies represents a critical health problem which drastically reduces therapeutic strategies. Indeed, as reported on the WHO website, resistance of *P. falciparum* to previous generations of medicines, such as chloroquine and sulfadoxine/pyrimethamine (SP), became widespread in the 1950s and 1960s, undermining malaria control efforts and reversing gains in child survival. Thus, the WHO recommends the routine monitoring of antimalarial drug resistance. Indeed, accurate diagnostic may avoid non appropriate treatments and limit extension of resistance to antimalarial medicines.

In this context the WHO Global Technical Strategy for Malaria 2016-2030—adopted by the World Health Assembly in May 2015—provides a technical framework for all malaria-endemic countries. It is intended to guide and support regional and country programs as they work towards malaria control and elimination. The Strategy sets ambitious but achievable global targets, including:

Reducing malaria case incidence by at least 90% by 2030.
Reducing malaria mortality rates by at least 90% by 2030.
Eliminating malaria in at least 35 countries by 2030.
Preventing a resurgence of malaria in all countries that are malaria-free.

This Strategy was the result of an extensive consultative process that spanned 2 years and involved the participation of more than 400 technical experts from 70 Member States. It is based on 3 key axes:

ensuring universal access to malaria prevention, diagnosis and treatment;
accelerating efforts towards elimination and attainment of malaria-free status; and
transforming malaria surveillance into a core intervention.

Treatment against *Plasmodium* include aryl-amino alcohols such as quinine or quinine derivatives such as chloroquine, amodiaquine, mefloquine, piperaquine, lumefantrine, primaquine; lipophilic hydroxynaphthoquinone analog, such as atovaquone; antifolate drugs, such as the sulfa drugs sulfadoxine, dapsone and pyrimethamine; proguanil; the combination of atovaquone/proguanil; artemisinin drugs; and combinations thereof.

Target sequences that are diagnostic for the presence of a mosquito-borne pathogen include sequence that diagnostic for the presence of *Plasmodium*, notably Plasmodia species affecting humans such as *Plasmodium falciparum, Plasmodium vivax, Plasmodium ovale, Plasmodium malariae*, and *Plasmodium knowlesi*, including sequences from the genomes thereof.

Target sequences that are diagnostic for monitoring drug resistance to treatment against *Plasmodium*, notably Plasmodia species affecting humans such as *Plasmodium falciparum, Plasmodium vivax, Plasmodium ovale, Plasmodium malariae*, and *Plasmodium knowlesi*.

Further target sequence include sequences include target molecules/nucleic acid molecules coding for proteins involved in essential biological process for the *Plasmodium* parasite and notably transporter proteins, such as protein from drug/metabolite transporter family, the ATP-binding cassette (ABC) protein involved in substrate translocation, such as the ABC transporter C subfamily or the Na+/H+ exchanger, membrane glutathione S-transferase; proteins involved in the folate pathway, such as the dihydropteroate synthase, the dihydrofolate reductase activity or the dihydrofolate reductase-thymidylate synthase; and proteins involved in the translocation of protons across the inner mitochondrial membrane and notably the cytochrome b complex. Additional target may also include the gene(s) coding for the heme polymerase.

Further target sequences include target molecules/nucleic acid molecules coding for proteins involved in essential biological process may be selected from the *P. falciparum* chloroquine resistance transporter gene (pfcrt), the *P. falciparum* multidrug resistance transporter 1 (pfindr1), the *P. falciparum* multidrug resistance-associated protein gene (Pfmrp), the *P. falciparum* Na+/H+ exchanger gene (pfnhe), the gene coding for the *P. falciparum* exported protein 1, the *P. falciparum* Ca2+ transporting ATPase 6 (pfatp6); the *P. falciparum* dihydropteroate synthase (pfdhps), dihydrofolate reductase activity (pfdhpr) and dihydrofolate reductase-thymidylate synthase (pfdhfr) genes, the cytochrome b gene, GTP cyclohydrolase and the Kelch13 (K13) gene as well as their functional heterologous genes in other *Plasmodium* species.

A number of mutations, notably single point mutations, have been identified in the proteins which are the targets of the current treatments and associated with specific resistance phenotypes. Accordingly, the invention allows for the detection of various resistance phenotypes of mosquito-borne parasites, such as *plasmodium*.

The invention allows to detect one or more mutation(s) and notably one or more single nucleotide polymorphisms in target nucleic acids/molecules. Accordingly any one of the mutations below, or their combination thereof, can be used as drug resistance marker and can be detected according to the invention.

Single point mutations in *P. falciparum* K13 include the following single point mutations in positions 252, 441, 446, 449, 458, 493, 539, 543, 553, 561, 568, 574, 578, 580, 675, 476, 469, 481, 522, 537, 538, 579, 584 and 719 and notably mutations E252Q, P441L, F446I, G449A, N458Y, Y493H, R539T, I543T, P553L, R561H, V568G, P574L, A578S, C580Y, A675V, M476I; C469Y; A481V; S522C; N537I; N537D; G538V; M579I; D584V; and H719N. These mutations are generally associated with artemisins drugs resistance phenotypes (Artemisinin and artemisinin-based combination therapy resistance, April 2016 WHO/HTM/GMP/2016.5).

In the *P. falciparum* dihydrofolate reductase (DHFR) (PfDHFR-TS, PFD0830w), important polymorphisms include mutations in positions 108, 51, 59 and 164, notably 108 D, 164L, 51I and 59R which modulate resistance to pyrimethamine. Other polymorphisms also include 437G, 581G, 540E, 436A and 613S which are associated with resistance to sulfadoxine. Additional observed mutations include Ser108Asn, Asn51Ile, Cys59Arg, Ile164Leu, Cys50Arg, Ile164Leu, Asn188Lys, Ser189Arg and Val213Ala, Ser108Thr and Ala16Val. Mutations Ser108Asn, Asn51Ile, Cys59Arg, Ile164Leu, Cys50Arg, Ile164Leu are notably associated with pyrimethamine based therapy and/or chloroguanine-dapsone combination therapy resistances. Cycloguanil resistance appears to be associated with the double mutations Ser108Thr and Ala16Val. Amplification of dhfr may also be of high relevance for therapy resistance notably pyrimethamine resistance.

In the *P. falciparum* dihydropteroate synthase (DHPS) (PfDHPS, PF08_0095), important polymorphisms include mutations in positions 436, 437, 581 and 613 Ser436Ala/Phe, Ala437Gly, Lys540Glu, Ala581Gly and Ala613Thr/Ser. Polymorphism in position 581 and/or 613 have also been associated with resistance to sulfadoxine-pyrimethamine base therapies.

In the *P. falciparum* chloroquine-resistance transporter (PfCRT), polymorphism in position 76, notably the mutation Lys76Thr, is associated with resistance to chloroquine. Further polymorphisms include Cys72Ser, Met74Ile, Asn75Glu, Ala220Ser, Gln271Glu, Asn326Ser, Ile356Thr and Arg371Ile which may be associated with chloroquine resistance. PfCRT is also phosphorylated at the residues S33, S411 and T416, which may regulate the transport activity or specificity of the protein.

In the *P. falciparum* multidrug-resistance transporter 1 (PfMDR1) (PFE1150w), polymorphisms in positions 86, 184, 1034, 1042, notably Asn86Tyr, Tyr184-Phe, Ser1034Cys, Asn1042Asp and Asp1246Tyr have been identified and reported to influence have been reported to influence susceptibilities to lumefantrine, artemisinin, quinine, mefloquine, halofantrine and chloroquine. Additionally, amplification of PfMDR1 is associated with reduced susceptibility to lumefantrine, artemisinin, quinine, mefloquine, and halofantrine and deamplification of PfMDR1 leads to an increase in chloroquine resistance. Amplification of pfmdr1 may also be detected. The phosphorylation status of PfMDR1 is also of high relevance.

In the *P. falciparum* multidrug-resistance associated protein (PfMRP) (gene reference PFA0590w), polymorphisms in positions 191 and/or 437, such as Y191H and A437S have been identified and associated with chloroquine resistance phenotypes.

In the *P. falciparum* NA+/H+ enchanger (PfNHE) (ref PF13_0019), increased repetition of the DNNND in microsatellite ms4670 may be a marker for quinine resistance.

Mutations altering the ubiquinol binding site of the cytochrome b protein encoded by the cytochrome bc gene (cytb, mal_mito_3) are associated with atovaquone resistance. Mutations in positions 26, 268, 276, 133 and 280 and notably Tyr26Asn, Tyr268Ser, M133I and G280D may be associated with atovaquone resistance.

For example in *P. vivax*, mutations in PvMDR1, the homolog of Pf MDR1 have been associated with chloroquine resistance, notably polymorphism in position 976 such as the mutation Y976F.

The above mutations are defined in terms of protein sequences. However, the skilled person is able to determine the corresponding mutations, including SNPS, to be identified as a nucleic acid target sequence.

Other identified drug-resistance markers are known in the art, for example as described in "*Susceptibility of Plasmodium falciparum to antimalarial drugs (1996-2004)*"; WHO; Artemisinin and artemisinin-based combination therapy resistance (April 2016 WHO/HTM/GMP/2016.5); "*Drug-resistant malaria: molecular mechanisms and implications for public health*" FEBS Lett. 2011 Jun. 6; 585(11): 1551-62. doi:10.1016/j.febslet.2011.04.042. Epub 2011 Apr. 23. Review. PubMed PMID: 21530510; the contents of which are herewith incorporated by reference As to polypeptides that may be detected in accordance with the present invention, gene products of all genes mentioned herein may be used as targets. Correspondingly, it is contemplated that such polypeptides could be used for species identification, typing and/or detection of drug resistance.

In certain example embodiments, the systems, devices, and methods, disclosed herein are directed to detecting the presence of one or more mosquito-borne parasite in a sample, such as a biological sample obtained from a subject. In certain example embodiments, the parasite may be selected from the species *Plasmodium falciparum, Plasmodium vivax, Plasmodium ovale, Plasmodium malariae* or *Plasmodium knowlesi*. Accordingly, the methods disclosed herein can be adapted for use in other methods (or in combination) with other methods that require quick identification of parasite species, monitoring the presence of parasites and parasite forms (for example corresponding to various stages of infection and parasite life-cycle, such as exo-erythrocytic cycle, erythrocytic cycle, sporogonic cycle; parasite forms include merozoites, sporozoites, schizonts, gametocytes); detection of certain phenotypes (e.g. pathogen drug resistance), monitoring of disease progression and/or outbreak, and treatment (drug) screening. Further, in the case of malaria, a long time may elapse following the infective bite, namely a long incubation period, during which the patient does not show symptoms. Similarly, prophylactic treatments can delay the appearance of symptoms, and long asymptomatic periods can also be observed before a relapse. Such delays can easily cause misdiagnosis or delayed diagnosis, and thus impair the effectiveness of treatment.

Because of the rapid and sensitive diagnostic capabilities of the embodiments disclosed here, detection of parasite type, down to a single nucleotide difference, and the ability to be deployed as a POC device, the embodiments disclosed herein may be used guide therapeutic regimens, such as selection of the appropriate course of treatment. The embodiments disclosed herein may also be used to screen environmental samples (mosquito population, etc.) for the presence and the typing of the parasite. The embodiments may also be modified to detect mosquito-borne parasites and other mosquito-borne pathogens simultaneously. In some instances, malaria and other mosquito-borne pathogens may present initially with similar symptoms. Thus, the ability to quickly distinguish the type of infection can guide important treatment decisions. Other mosquito-borne pathogens that may be detected in conjunction with malaria include dengue, West Nile virus, chikungunya, yellow fever, filariasis, Japanese encephalitis, Saint Louis encephalitis, western equine encephalitis, eastern equine encephalitis, Venezuelan equine encephalitis, La Crosse encephalitis, and zika.

In certain example embodiments, the devices, systems, and methods disclosed herein may be used to distinguish multiple mosquito-borne parasite species in a sample. In certain example embodiments, identification may be based on ribosomal RNA sequences, including the 18S, 16S, 23S, and 5S subunits. In certain example embodiments, identification may be based on sequences of genes that are present in multiple copies in the genome, such as mitochondrial genes like CYTB. In certain example embodiments, identification may be based on sequences of genes that are highly expressed and/or highly conserved such as GAPDH, Histone H2B, enolase, or LDH. Methods for identifying relevant rRNA sequences are disclosed in U.S. Patent Application Publication No. 2017/0029872. In certain example embodiments, a set of guide RNA may designed to distinguish each species by a variable region that is unique to each species or strain. Guide RNAs may also be designed to target RNA genes that distinguish microbes at the genus, family, order, class, phylum, kingdom levels, or a combination thereof. In certain example embodiments where amplification is used, a set of amplification primers may be designed to flanking constant regions of the ribosomal RNA sequence and a guide RNA designed to distinguish each species by a variable internal region. In certain example embodiments, the primers and guide RNAs may be designed to conserved and variable regions in the 16S subunit respectfully. Other genes or genomic regions that uniquely variable across species or a subset of species such as the RecA gene family, RNA polymerase p subunit, may be used as well. Other suitable phylogenetic markers, and methods for identifying the same, are discussed for example in Wu et al. arXiv:1307.8690 [q-bio.GN].

In certain example embodiments, species identification can be performed based on genes that are present in multiple copies in the genome, such as mitochondrial genes like CYTB. In certain example embodiments, species identification can be performed based on highly expressed and/or highly conserved genes such as GAPDH, Histone H2B, enolase, or LDH.

In certain example embodiments, a method or diagnostic is designed to screen mosquito-borne parasites across multiple phylogenetic and/or phenotypic levels at the same time. For example, the method or diagnostic may comprise the use of multiple CRISPR systems with different guide RNAs. A first set of guide RNAs may distinguish, for example, between *Plasmodium falciparum* or *Plasmodium vivax*. These general classes can be even further subdivided. For example, guide RNAs could be designed and used in the method or diagnostic that distinguish drug-resistant strains, in general or with respect to a specific drug or combination of drugs. A second set of guide RNA can be designed to distinguish microbes at the species level. Thus a matrix may be produced identifying all mosquito-borne parasites species or subspecies, further divided according to drug resistance. The foregoing is for example purposes only. Other means for classifying other types of mosquito-borne parasites are also contemplated and would follow the general structure described above.

In certain example embodiments, the devices, systems and methods disclosed herein may be used to screen for mosquito-borne parasite genes of interest, for example drug resistance genes. Guide RNAs may be designed to distinguish between known genes of interest. Samples, including clinical samples, may then be screened using the embodiments disclosed herein for detection of one or more such genes. The ability to screen for drug resistance at POC would have tremendous benefit in selecting an appropriate treatment regime. In certain example embodiments, the drug resistance genes are genes encoding proteins such as transporter proteins, such as protein from drug/metabolite transporter family, the ATP-binding cassette (ABC) protein involved in substrate translocation, such as the ABC transporter C subfamily or the Na+/H+ exchanger; proteins involved in the folate pathway, such as the dihydropteroate synthase, the dihydrofolate reductase activity or the dihydrofolate reductase-thymidylate synthase; and proteins involved in the translocation of protons across the inner mitochondrial membrane and notably the cytochrome b complex. Additional targets may also include the gene(s) coding for the heme polymerase. In certain example embodiments, the drug resistance genes are selected from the *P. falciparum* chloroquine resistance transporter gene (pfcrt), the *P. falciparum* multidrug resistance transporter 1 (pfmdr 1), the *P. falciparum* multidrug resistance-associated protein gene (Pfmrp), the *P. falciparum* Na+/H+ exchanger gene (pfnhe), the *P. falciparum* Ca2+ transporting ATPase 6 (pfatp6), the *P. falciparum* dihydropteroate synthase (pfdhps), dihydrofolate reductase activity (pfdhpr) and dihydrofolate reductase-thymidylate synthase (pfdhfr) genes, the cytochrome b gene, GTP cyclohydrolase and the Kelch13 (K13) gene as well as their functional heterologous genes in other *Plasmodium* species. Other identified drug-resistance markers are known in the art, for example as described in "*Susceptibility of Plasmodium falciparum to antimalarial drugs (1996-2004)*", WHO; Artemisinin and artemisinin-based combination therapy resistance (April 2016 WHO/HTM/GMP/2016.5); "*Drug-resistant malaria: molecular mechanisms and implications for public health*" FEBS Lett. 2011 Jun. 6; 585(11):1551-62. doi:10.1016/j.febslet.2011.04.042. Epub 2011 Apr. 23. Review. PubMed PMID: 21530510; the contents of which are herewith incorporated by reference.

In some embodiments, a CRISPR system, detection system or methods of use thereof as described herein may be used to determine the evolution of a mosquito-borne parasite outbreak. The method may comprise detecting one or more target sequences from a plurality of samples from one or more subjects, wherein the target sequence is a sequence from a mosquito-borne parasite spreading or causing the outbreaks. Such a method may further comprise determining a pattern of mosquito-borne parasite transmission, or a mechanism involved in a disease outbreak caused by a mosquito-borne parasite. The samples may be derived from one or more humans, and/or be derived from one or more mosquitoes.

The pattern of pathogen transmission may comprise continued new transmissions from the natural reservoir of the mosquito-borne parasite or other transmissions (e.g. across mosquitoes) following a single transmission from the natural reservoir or a mixture of both. In one embodiment, the target sequence is preferably a sequence within the mosquito-borne parasite genome or fragments thereof. In one embodiment, the pattern of the mosquito-borne parasite transmission is the early pattern of the mosquito-borne parasite transmission, i.e. at the beginning of the mosquito-borne parasite outbreak. Determining the pattern of the mosquito-borne parasite transmission at the beginning of the outbreak increases likelihood of stopping the outbreak at the earliest possible time thereby reducing the possibility of local and international dissemination.

Determining the pattern of the mosquito-borne parasite transmission may comprise detecting a mosquito-borne parasite sequence according to the methods described herein. Determining the pattern of the pathogen transmission may further comprise detecting shared intra-host variations of the mosquito-borne parasite sequence between the subjects and determining whether the shared intra-host variations show temporal patterns. Patterns in observed intrahost and interhost variation provide important insight about transmission and epidemiology (Gire, et al., 2014).

In addition to other sample types disclosed herein, the sample may be derived from one or more mosquitoes, for example the sample may comprise mosquito saliva.

Biomarker Detection

In certain example embodiments, the systems, devices, and methods disclosed herein may be used for biomarker detection. For example, the systems, devices and method disclosed herein may be used for SNP detection and/or genotyping. The systems, devices and methods disclosed herein may be also used for the detection of any disease state or disorder characterized by aberrant gene expression. Aberrant gene expression includes aberration in the gene expressed, location of expression and level of expression. Multiple transcripts or protein markers related to cardiovascular, immune disorders, and cancer among other diseases may be detected. In certain example embodiments, the embodiments disclosed herein may be used for cell free DNA detection of diseases that involve lysis, such as liver fibrosis and restrictive/obstructive lung disease. In certain example embodiments, the embodiments could be utilized for faster and more portable detection for pre-natal testing of cell-free DNA. The embodiments disclosed herein may be used for screening panels of different SNPs associated with, among others, cardiovascular health, lipid/metabolic signatures, ethnicity identification, paternity matching, human ID (e.g. matching suspect to a criminal database of SNP signatures). The embodiments disclosed herein may also be used for cell free DNA detection of mutations related to and released from cancer tumors. The embodiments disclosed herein may also be used for detection of meat quality, for example, by providing rapid detection of different animal sources in a given meat product. Embodiments disclosed herein may also be used for the detection of GMOs or gene editing related to DNA. As described herein elsewhere, closely related genotypes/alleles or biomarkers (e.g. having only a single nucleotide difference in a given target sequence) may be distinguished by introduction of a synthetic mismatch in the gRNA.

In an aspect, the invention relates to a method for detecting target nucleic acids in samples, comprising:
  a. distributing a sample or set of samples into one or more individual discrete volumes, the individual discrete volumes comprising a CRISPR system according to the invention as described herein;
  b. incubating the sample or set of samples under conditions sufficient to allow binding of the one or more guide RNAs to one or more target molecules;
  c. activating the CRISPR effector protein via binding of the one or more guide RNAs to the one or more target molecules, wherein activating the CRISPR effector protein results in modification of the RNA-based masking construct such that a detectable positive signal is generated; and
  d. detecting the detectable positive signal, wherein detection of the detectable positive signal indicates a presence of one or more target molecules in the sample.

Biomarker Sample Types

The sensitivity of the assays described herein are well suited for detection of target nucleic acids in a wide variety of biological sample types, including sample types in which the target nucleic acid is dilute or for which sample material is limited. Biomarker screening may be carried out on a number of sample types including, but not limited to, saliva, urine, blood, feces, sputum, and cerebrospinal fluid. The embodiments disclosed herein may also be used to detect up- and/or down-regulation of genes. For example, a s sample may be serially diluted such that only over-expressed genes remain above the detection limit threshold of the assay.

In certain embodiments, the present invention provides steps of obtaining a sample of biological fluid (e.g., urine, blood plasma or serum, sputum, cerebral spinal fluid), and extracting the DNA. The mutant nucleotide sequence to be detected, may be a fraction of a larger molecule or can be present initially as a discrete molecule.

In certain embodiments, DNA is isolated from plasma/serum of a cancer patient. For comparison, DNA samples isolated from neoplastic tissue and a second sample may be isolated from non-neoplastic tissue from the same patient (control), for example, lymphocytes. The non-neoplastic tissue can be of the same type as the neoplastic tissue or from a different organ source. In certain embodiments, blood samples are collected and plasma immediately separated from the blood cells by centrifugation. Serum may be filtered and stored frozen until DNA extraction.

In certain example embodiments, target nucleic acids are detected directly from a crude or unprocessed sample, such as blood, serum, saliva, cerebrospinal fluid, sputum, or urine. In certain example embodiments, the target nucleic acid is cell free DNA.

Circulating Tumor Cells

In one embodiment, circulating cells (e.g., circulating tumor cells (CTC)) can be assayed with the present invention. Isolation of circulating tumor cells (CTC) for use in any of the methods described herein may be performed. Exemplary technologies that achieve specific and sensitive detection and capture of circulating cells that may be used in the present invention have been described (Mostert B, et al., Circulating tumor cells (CTCs): detection methods and their clinical relevance in breast cancer. Cancer Treat Rev. 2009; 35:463-474; and Talasaz A H, et al., Isolating highly enriched populations of circulating epithelial cells and other rare cells from blood using a magnetic sweeper device. Proc Natl Acad Sci USA. 2009; 106: 3970-3975). As few as one CTC may be found in the background of 105-106 peripheral blood mononuclear cells (Ross A A, et al., Detection and viability of tumor cells in peripheral blood stem cell collections from breast cancer patients using immunocytochemical and clonogenic assay techniques. Blood. 1993,82:2605-2610). The Cell Search® platform uses immunomagnetic beads coated with antibodies to Epithelial Cell Adhesion Molecule (EpCAM) to enrich for EPCAM-expressing epithelial cells, followed by immunostaining to confirm the presence of cytokeratin staining and absence of the leukocyte marker CD45 to confirm that captured cells are epithelial tumor cells (Momburg F, et al., Immunohistochemical study of the expression of a Mr 34,000 human epithelium-specific surface glycoprotein in normal and malignant tissues. Cancer Res. 1987; 47:2883-2891; and Allard W J, et al., Tumor cells circulate in the peripheral blood of all major carcinomas but not in healthy subjects or patients with nonmalignant diseases. Clin Cancer Res. 2004; 10:6897-6904). The number of cells captured have been prospectively demonstrated to have prognostic significance for breast, colorectal and prostate cancer patients with advanced disease (Cohen S J, et al., J Clin Oncol. 2008; 26:3213-3221; Cristofanilli M, et al. N Engl J Med. 2004; 351:781-791; Cristofanilli M, et al., J Clin Oncol. 2005; 23: 1420-1430; and de Bono J S, et al. Clin Cancer Res. 2008; 14:6302-6309).

The present invention also provides for isolating CTCs with CTC-Chip Technology. CTC-Chip is a microfluidic based CTC capture device where blood flows through a chamber containing thousands of microposts coated with anti-EpCAM antibodies to which the CTCs bind (Nagrath S, et al. Isolation of rare circulating tumor cells in cancer patients by microchip technology. Nature. 2007; 450: 1235-1239). CTC-Chip provides a significant increase in CTC counts and purity in comparison to the CellSearch® system (Maheswaran S, et al. Detection of mutations in EGFR in circulating lung-cancer cells, N Engl J Med. 2008; 359:366-377), both platforms may be used for downstream molecular analysis.

Cell-Free Chromatin

In certain embodiments, cell free chromatin fragments are isolated and analyzed according to the present invention. Nucleosomes can be detected in the serum of healthy individuals (Stroun et al., Annals of the New York Academy of Sciences 906: 161-168 (2000)) as well as individuals afflicted with a disease state. Moreover, the serum concentration of nucleosomes is considerably higher in patients suffering from benign and malignant diseases, such as cancer and autoimmune disease (Holdenrieder et al (2001) Int J Cancer 95, 1 14-120, Trejo-Becerril et al (2003) Int J Cancer 104, 663-668; Kuroi et al 1999 Breast Cancer 6, 361-364; Kuroi et al (2001) Int j Oncology 19, 143-148; Amoura et al (1997) Arth Rheum 40, 2217-2225; Williams et al (2001) J Rheumatol 28, 81-94). Not being bound by a theory, the high concentration of nucleosomes in tumor bearing patients derives from apoptosis, which occurs spontaneously in proliferating tumors. Nucleosomes circulating in the blood contain uniquely modified histones. For example, U.S. Patent Publication No. 2005/0069931 (Mar. 31, 2005) relates to the use of antibodies directed against specific histone N-terminus modifications as diagnostic indicators of disease, employing such histone-specific antibodies to isolate nucleosomes from a blood or serum sample of a patient to facilitate purification and analysis of the accompanying DNA for diagnostic/screening purposes. Accordingly, the present invention may use chromatin bound DNA to detect and monitor, for example, tumor mutations. The identification of the DNA associated with modified histones can serve as diagnostic markers of disease and congenital defects.

Thus, in another embodiment, isolated chromatin fragments are derived from circulating chromatin, preferably circulating mono and oligonucleosomes. Isolated chromatin fragments may be derived from a biological sample. The biological sample may be from a subject or a patient in need thereof. The biological sample may be sera, plasma, lymph, blood, blood fractions, urine, synovial fluid, spinal fluid, saliva, circulating tumor cells or mucous.

Cell-Free DNA (cfDNA)

In certain embodiments, the present invention may be used to detect cell free DNA (cfDNA). Cell free DNA in plasma or serum may be used as a non-invasive diagnostic tool. For example, cell free fetal DNA has been studied and optimized for testing on-compatible RhD factors, sex determination for X-linked genetic disorders, testing for single gene disorders, identification of preeclampsia. For example, sequencing the fetal cell fraction of cfDNA in maternal plasma is a reliable approach for detecting copy number changes associated with fetal chromosome aneuploidy. For another example, cfDNA isolated from cancer patients has been used to detect mutations in key genes relevant for treatment decisions.

In certain example embodiments, the present disclosure provides detecting cfDNA directly from a patient sample. In certain other example embodiment, the present disclosure provides enriching cfDNA using the enrichment embodiments disclosed above and prior to detecting the target cfDNA.

Exosomes

In one embodiment, exosomes can be assayed with the present invention. Exosomes are small extracellular vesicles that have been shown to contain RNA. Isolation of exosomes by ultracentrifugation, filtration, chemical precipitation, size exclusion chromatography, and microfluidics are known in the art. In one embodiment exosomes are purified using an exosome biomarker. Isolation and purification of exosomes from biological samples may be performed by any known methods (see e.g., WO2016172598A1).

SNP Detection and Genotyping

In certain embodiments, the present invention may be used to detect the presence of single nucleotide polymorphisms (SNP) in a biological sample. The SNPs may be related to maternity testing (e.g., sex determination, fetal defects). They may be related to a criminal investigation. In one embodiment, a suspect in a criminal investigation may be identified by the present invention. Not being bound by a theory nucleic acid based forensic evidence may require the most sensitive assay available to detect a suspect or victim's genetic material because the samples tested may be limiting.

In other embodiments, SNPs associated with a disease are encompassed by the present invention. SNPs associated with diseases are well known in the art and one skilled in the art can apply the methods of the present invention to design suitable guide RNAs (see e.g., www.ncbi.nlm.nih.gov/clinvar?term=human%5Borgn%5D).

In an aspect, the invention relates to a method for genotyping, such as SNP genotyping, comprising:
   a) distributing a sample or set of samples into one or more individual discrete volumes, the individual discrete volumes comprising a CRISPR system according to the invention as described herein;

b) incubating the sample or set of samples under conditions sufficient to allow binding of the one or more guide RNAs to one or more target molecules;

c) activating the CRISPR effector protein via binding of the one or more guide RNAs to the one or more target molecules, wherein activating the CRISPR effector protein results in modification of the RNA-based masking construct such that a detectable positive signal is generated; and d) detecting the detectable positive signal, wherein detection of the detectable positive signal indicates a presence of one or more target molecules characteristic for a particular genotype in the sample.

In certain embodiments, the detectable signal is compared to (e.g. by comparison of signal intensity) one or more standard signal, preferably a synthetic standard signal, such as for instance illustrated in an example embodiment in FIGS. 60A-60E. In certain embodiments, the standard is or corresponds to a particular genotype. In certain embodiments, the standard comprises a particular SNP or other (single) nucleotide variation. In certain embodiments, the standard is a (PCR-amplified) genotype standard. In certain embodiments, the standard is or comprises DNA. In certain embodiments, the standard is or comprises RNA. In certain embodiments, the standard is or comprised RNA which is transcribed from DNA. In certain embodiments, the standard is or comprises DNA which is reverse transcribed from RNA. In certain embodiments, the detectable signal is compared to one or more standard, each of which corresponds to a known genotype, such as a SNP or other (single) nucleotide variation. In certain embodiments, the detectable signal is compared to one or more standard signal and the comparison comprises statistical analysis, such as by parametric or non-parametric statistical analysis, such as by one- or two-way ANOVA, etc. In certain embodiments, the detectable signal is compared to one or more standard signal and when the detectable signal does not (statistically) significantly deviate from the standard, the genotype is determined as the genotype corresponding to said standard.

In other embodiments, the present invention allows rapid genotyping for emergency pharmacogenomics. In one embodiment, a single point of care assay may be used to genotype a patient brought in to the emergency room. The patient may be suspected of having a blood clot and an emergency physician needs to decide a dosage of blood thinner to administer. In exemplary embodiments, the present invention may provide guidance for administration of blood thinners during myocardial infarction or stroke treatment based on genotyping of markers such as VKORC1, CYP2C9, and CYP2C19. In one embodiment, the blood thinner is the anticoagulant warfarin (Holford, N.H. (December 1986). "Clinical Pharmacokinetics and Pharmacodynamics of Warfarin Understanding the Dose-Effect Relationship". Clinical Pharmacokinetics. Springer International Publishing. 11 (6): 483-504). Genes associated with blood clotting are known in the art (see e.g., US20060166239A1; Litin S C, Gastineau DA (1995) "Current concepts in anticoagulant therapy". Mayo Clin. Proc. 70 (3): 266-72; and Rusdiana et al., Responsiveness to low-dose warfarin associated with genetic variants of VKORC1, CYP2C9, CYP2C19, and CYP4F2 in an Indonesian population. Eur J Clin Pharmacol. 2013 March; 69(3):395-405). Specifically, in the VKORC1 1639 (or 3673) single-nucleotide polymorphism, the common ("wild-type") G allele is replaced by the A allele. People with an A allele (or the "A haplotype") produce less VKORC1 than do those with the G allele (or the "non-A haplotype"). The prevalence of these variants also varies by race, with 37% of Caucasians and 14% of Africans carrying the A allele. The end result is a decreased number of clotting factors and therefore, a decreased ability to clot.

In certain example embodiments, the availability of genetic material for detecting a SNP in a patient allows for detecting SNPs without amplification of a DNA or RNA sample. In the case of genotyping, the biological sample tested is easily obtained. In certain example embodiments, the incubation time of the present invention may be shortened. The assay may be performed in a period of time required for an enzymatic reaction to occur. One skilled in the art can perform biochemical reactions in 5 minutes (e.g., 5 minute ligation). The present invention may use an automated DNA extraction device to obtain DNA from blood. The DNA can then be added to a reaction that generates a target molecule for the effector protein. Immediately upon generating the target molecule the masking agent can be cut and a signal detected. In exemplary embodiments, the present invention allows a POC rapid diagnostic for determining a genotype before administering a drug (e.g., blood thinner). In the case where an amplification step is used, all of the reactions occur in the same reaction in a one step process. In preferred embodiments, the POC assay may be performed in less than an hour, preferably 10 minutes, 20 minutes, 30 minutes, 40 minutes, or 50 minutes.

In certain embodiments, the systems, devices, and methods disclosed herein may be used for detecting the presence or expression level of long non-coding RNAs (lncRNAs). Expression of certain lncRNAs are associated with disease state and/or drug resistance. In particular, certain lncRNAs (e.g., TCONS_00011252, NR_034078, TCONS_00010506, TCONS_00026344, TCONS_00015940, TCONS_00028298, TCONS_00026380, TCONS_0009861, TCONS_00026521, TCONS_00016127, NR_125939, NR_033834, TCONS_00021026, TCONS_00006579, NR_109890, and NR_026873) are associated with resistance to cancer treatment, such as resistance to one or more BRAF inhibitors (e.g., Vemurafenib, Dabrafenib, Sorafenib, GDC-0879, PLX-4720, and LGX818) for treating melanoma (e.g., nodular melanoma, lentigo maligna, lentigo maligna melanoma, acral lentiginous melanoma, superficial spreading melanoma, mucosal melanoma, polypoid melanoma, desmoplastic melanoma, amelanotic melanoma, and soft-tissue melanoma). The detection of lncRNAs using the various embodiments described herein can facilitate disease diagnosis and/or selection of treatment options.

In one embodiment, the present invention can guide DNA- or RNA-targeted therapies (e.g., CRISPR, TALE, Zinc finger proteins, RNAi), particularly in settings where rapid administration of therapy is important to treatment outcomes.

LOH Detection

Cancer cells undergo a loss of genetic material (DNA) when compared to normal cells. This deletion of genetic material which almost all, if not all, cancers undergo is referred to as "loss of heterozygosity" (LOH). Loss of heterozygosity (LOH) is a gross chromosomal event that results in loss of the entire gene and the surrounding chromosomal region. The loss of heterozygosity is a common occurrence in cancer, where it can indicate the absence of a functional tumor suppressor gene in the lost region. However, a loss may be silent because there still is one functional gene left on the other chromosome of the chromosome pair. The remaining copy of the tumor suppressor gene can be inactivated by a point mutation, leading to loss of a tumor suppressor gene. The loss of genetic material from cancer cells can result in the selective loss of one of two or more alleles of a gene vital for cell viability or cell growth at a particular locus on the chromosome.

An "LOH marker" is DNA from a microsatellite locus, a deletion, alteration, or amplification in which, when compared to normal cells, is associated with cancer or other diseases. An LOH marker often is associated with loss of a tumor suppressor gene or another, usually tumor related, gene.

The term "microsatellites" refers to short repetitive sequences of DNA that are widely distributed in the human genome. A microsatellite is a tract of tandemly repeated (i.e. adjacent) DNA motifs that range in length from two to five nucleotides, and are typically repeated 5-50 times. For example, the sequence TATATATATA (SEQ. I.D. No. 418) is a dinucleotide microsatellite, and GTCGTCGTCGTCGTC (SEQ. I.D. No. 419) is a trinucleotide microsatellite (with A being Adenine, G Guanine, C Cytosine, and T Thymine). Somatic alterations in the repeat length of such microsatellites have been shown to represent a characteristic feature of tumors. Guide RNAs may be designed to detect such microsatellites. Furthermore, the present invention may be used to detect alterations in repeat length, as well as amplifications and deletions based upon quantitation of the detectable signal. Certain microsatellites are located in regulatory flanking or intronic regions of genes, or directly in codons of genes. Microsatellite mutations in such cases can lead to phenotypic changes and diseases, notably in triplet expansion diseases such as fragile X syndrome and Huntington's disease.

Frequent loss of heterozygosity (LOH) on specific chromosomal regions has been reported in many kinds of malignancies. Allelic losses on specific chromosomal regions are the most common genetic alterations observed in a variety of malignancies, thus microsatellite analysis has been applied to detect DNA of cancer cells in specimens from body fluids, such as sputum for lung cancer and urine for bladder cancer. (Rouleau, et al. Nature 363, 515-521 (1993); and Latif, et al. Science 260, 1317-1320 (1993)). Moreover, it has been established that markedly increased concentrations of soluble DNA are present in plasma of individuals with cancer and some other diseases, indicating that cell free serum or plasma can be used for detecting cancer DNA with microsatellite abnormalities. (Kamp, et al. Science 264, 436-440 (1994); and Steck, et al. Nat Genet. 15(4), 356-362 (1997)). Two groups have reported microsatellite alterations in plasma or serum of a limited number of patients with small cell lung cancer or head and neck cancer. (Hahn, et al. Science 271, 350-353 (1996); and Miozzo, et al. Cancer Res. 56, 2285-2288 (1996)). Detection of loss of heterozygosity in tumors and serum of melanoma patients has also been previously shown (see, e.g., United States patent number U.S. Pat. No. 6,465,177B1).

Thus, it is advantageous to detect of LOH markers in a subject suffering from or at risk of cancer. The present invention may be used to detect LOH in tumor cells. In one embodiment, circulating tumor cells may be used as a biological sample. In preferred embodiments, cell free DNA obtained from serum or plasma is used to noninvasively detect and/or monitor LOH. In other embodiments, the biological sample may be any sample described herein (e.g., a urine sample for bladder cancer). Not being bound by a theory, the present invention may be used to detect LOH markers with improved sensitivity as compared to any prior method, thus providing early detection of mutational events. In one embodiment, LOH is detected in biological fluids, wherein the presence of LOH is associated with the occurrence of cancer. The method and systems described herein represents a significant advance over prior techniques, such as PCR or tissue biopsy by providing a non-invasive, rapid, and accurate method for detecting LOH of specific alleles associated with cancer. Thus, the present invention provides a methods and systems which can be used to screen high-risk populations and to monitor high risk patients undergoing chemoprevention, chemotherapy, immunotherapy or other treatments.

Because the method of the present invention requires only DNA extraction from bodily fluid such as blood, it can be performed at any time and repeatedly on a single patient. Blood can be taken and monitored for LOH before or after surgery; before, during, and after treatment, such as chemotherapy, radiation therapy, gene therapy or immunotherapy; or during follow-up examination after treatment for disease progression, stability, or recurrence. Not being bound by a theory, the method of the present invention also may be used to detect subclinical disease presence or recurrence with an LOH marker specific for that patient since LOH markers are specific to an individual patient's tumor. The method also can detect if multiple metastases may be present using tumor specific LOH markers.

Detection of Epigenetic Modifications

Histone variants, DNA modifications, and histone modifications indicative of cancer or cancer progression may be used in the present invention. For example, U.S. patent publication 20140206014 describes that cancer samples had elevated nucleosome H2AZ, macroH2A1.1, 5-methylcytosine, P-H2AX(Ser139) levels as compared to healthy subjects. The presence of cancer cells in an individual may generate a higher level of cell free nucleosomes in the blood as a result of the increased apoptosis of the cancer cells. In one embodiment, an antibody directed against marks associated with apoptosis, such as H2B Ser 14(P), may be used to identify single nucleosomes that have been released from apoptotic neoplastic cells. Thus, DNA arising from tumor cells may be advantageously analyzed according to the present invention with high sensitivity and accuracy.

Pre-Natal Screening

In certain embodiments, the method and systems of the present invention may be used in prenatal screening. In certain embodiments, cell-free DNA is used in a method of prenatal screening. In certain embodiments, DNA associated with single nucleosomes or oligonucleosomes may be detected with the present invention. In preferred embodiments, detection of DNA associated with single nucleosomes or oligonucleosomes is used for prenatal screening. In certain embodiments, cell-free chromatin fragments are used in a method of prenatal screening.

Prenatal diagnosis or prenatal screening refers to testing for diseases or conditions in a fetus or embryo before it is born. The aim is to detect birth defects such as neural tube defects, Down syndrome, chromosome abnormalities, genetic disorders and other conditions, such as spina bifida, cleft palate, Tay Sachs disease, sickle cell anemia, thalassemia, cystic fibrosis, Muscular dystrophy, and fragile X syndrome. Screening can also be used for prenatal sex discernment. Common testing procedures include amniocentesis, ultrasonography including nuchal translucency ultrasound, serum marker testing, or genetic screening. In some cases, the tests are administered to determine if the fetus will be aborted, though physicians and patients also find it useful to diagnose high-risk pregnancies early so that delivery can be scheduled in a tertian,' care hospital where the baby can receive appropriate care.

It has been realized that there are fetal cells which are present in the mother's blood, and that these cells present a potential source of fetal chromosomes for prenatal DNA-based diagnostics. Additionally, fetal DNA ranges from about 2-10% of the total DNA in maternal blood. Currently available prenatal genetic tests usually involve invasive procedures. For example, chorionic villus sampling (CVS) performed on a pregnant woman around 10-12 weeks into the pregnancy and amniocentesis performed at around 14-16 weeks all contain invasive procedures to obtain the sample for testing chromosomal abnormalities in a fetus. Fetal cells obtained via these sampling procedures are usually tested for chromosomal abnormalities using cytogenetic or fluorescent in situ hybridization (FISH) analyses. Cell-free fetal DNA has been shown to exist in plasma and serum of pregnant women as early as the sixth week of gestation, with concentrations rising during pregnancy and peaking prior to parturition. Because these cells appear very early in the pregnancy, they could form the basis of an accurate, non-invasive, first trimester test. Not being bound by a theory, the present invention provides unprecedented sensitivity in detecting low amounts of fetal DNA. Not being bound by a theory, abundant amounts of maternal DNA is generally concomitantly recovered along with the fetal DNA of interest, thus decreasing sensitivity in fetal DNA quantification and mutation detection. The present invention overcomes such problems by the unexpectedly high sensitivity of the assay.

The H3 class of histones consists of four different protein types: the main types, H3.1 and H3.2; the replacement type, H3.3; and the testis specific variant, H3t. Although H3.1 and H3.2 are closely related, only differing at Ser96, H3.1 differs from H3.3 in at least 5 amino acid positions. Further, H3.1 is highly enriched in fetal liver, in comparison to its presence in adult tissues including liver, kidney and heart. In adult human tissue, the H3.3 variant is more abundant than the H3.1 variant, whereas the converse is true for fetal liver. The present invention may use these differences to detect fetal nucleosomes and fetal nucleic acid in a maternal biological sample that comprises both fetal and maternal cells and/or fetal nucleic acid.

In one embodiment, fetal nucleosomes may be obtained from blood. In other embodiments, fetal nucleosomes are obtained from a cervical mucus sample. In certain embodiments, a cervical mucus sample is obtained by swabbing or lavage from a pregnant woman early in the second trimester or late in the first trimester of pregnancy. The sample may be placed in an incubator to release DNA trapped in mucus. The incubator may be set at 37° C. The sample may be rocked for approximately 15 to 30 minutes. Mucus may be further dissolved with a mucinase for the purpose of releasing DNA. The sample may also be subjected to conditions, such as chemical treatment and the like, as well known in the art, to induce apoptosis to release fetal nucleosomes. Thus, a cervical mucus sample may be treated with an agent that induces apoptosis, whereby fetal nucleosomes are released. Regarding enrichment of circulating fetal DNA, reference is made to U.S. patent publication Nos. 20070243549 and 20100240054. The present invention is especially advantageous when applying the methods and systems to prenatal screening where only a small fraction of nucleosomes or DNA may be fetal in origin.

Prenatal screening according to the present invention may be for a disease including, but not limited to Trisomy 13, Trisomy 16, Trisomy 18, Klinefelter syndrome (47, XXY), (47, XYY) and (47, XXX), Turner syndrome, Down syndrome (Trisomy 21), Cystic Fibrosis, Huntington's Disease, Beta Thalassaemia, Myotonic Dystrophy, Sickle Cell Anemia, Porphyria, Fragile-X-Syndrome, Robertsonian translocation, Angelman syndrome, DiGeorge syndrome and Wolf-Hirschhorn Syndrome.

Several further aspects of the invention relate to diagnosing, prognosing and/or treating defects associated with a wide range of genetic diseases which are further described on the website of the National Institutes of Health under the topic subsection Genetic Disorders (website at health.nih.gov/topic/Genetic Disorders).

Cancer and Cancer Drug Resistance Detection

In certain embodiments, the present invention may be used to detect genes and mutations associated with cancer. In certain embodiments, mutations associated with resistance are detected. The amplification of resistant tumor cells or appearance of resistant mutations in clonal populations of tumor cells may arise during treatment (see, e.g., Burger J A, et al., Clonal evolution in patients with chronic lymphocytic leukaemia developing resistance to BTK inhibition. Nat Commun. 2016 May 20; 7:11589; Landau D A, et al., Mutations driving CLL and their evolution in progression and relapse. Nature. 2015 Oct. 22; 526(7574):525-30; Landau D A, et al., Clonal evolution in hematological malignancies and therapeutic implications. Leukemia. 2014 January; 28(1):34-43; and Landau D A, et al., Evolution and impact of subclonal mutations in chronic lymphocytic leukemia. Cell. 2013 Feb. 14; 152(4):714-26). Accordingly, detecting such mutations requires highly sensitive assays and monitoring requires repeated biopsy. Repeated biopsies are inconvenient, invasive and costly. Resistant mutations can be difficult to detect in a blood sample or other noninvasively collected biological sample (e.g., blood, saliva, urine) using the prior methods known in the art. Resistant mutations may refer to mutations associated with resistance to a chemotherapy, targeted therapy, or immunotherapy.

In certain embodiments, mutations occur in individual cancers that may be used to detect cancer progression. In one embodiment, mutations related to T cell cytolytic activity against tumors have been characterized and may be detected by the present invention (see e.g., Rooney et al., Molecular and genetic properties of tumors associated with local immune cytolytic activity, Cell. 2015 January 15; 160(1-2): 48-61). Personalized therapies may be developed for a patient based on detection of these mutations (see e.g., WO2016100975A1). In certain embodiments, cancer specific mutations associated with cytolytic activity may be a mutation in a gene selected from the group consisting of CASP8, B2M, PIK3CA, SMC1A, ARID5B, TET2, ALPK2, COL5A1, TP53, DNER, NCOR1, MORC4, CIC, IRF6, MYOCD, ANKLET, CNKSR1, NF1, SOS1, ARID2, CUL4B, DDX3X, FUBP1, TCP11L2, HLA-A, B or C, CSNK2A1, MET, ASXL1, PD-L1, PD-L2, IDO1, IDO2, ALOX12B and ALOX15B, or copy number gain, excluding whole-chromosome events, impacting any of the following chromosomal bands: 6q16.1-q21, 6q22.31-q24.1, 6q25.1-q26, 7p11.2-q11.1, 8p23.1, 8p11.23-p11.21 (containing IDO1, IDO2), 9p24.2-p23 (containing PDL1, PDL2), 10p15.3, 10p15.1-p13, 11p14.1, 12p13.32-p13.2, 17p13.1 (containing ALOX12B, ALOX15B), and 22q11.1-q11.21.

In certain embodiments, the present invention is used to detect a cancer mutation (e.g., resistance mutation) during the course of a treatment and after treatment is completed. The sensitivity of the present invention may allow for noninvasive detection of clonal mutations arising during treatment and can be used to detect a recurrence in the disease.

In certain example embodiments, detection of microR-NAs (miRNA) and/or miRNA signatures of differentially expressed miRNA, may be used to detect or monitor progression of a cancer and/or detect drug resistance to a cancer therapy. As an example, Nadal et al. (Nature Scientific Reports, (2015) doi:10.1038/srep12464) describe mRNA signatures that may be used to detect non-small cell lung cancer (NSCLC).

In certain example embodiments, the presence of resistance mutations in clonal subpopulations of cells may be used in determining a treatment regimen. In other embodiments, personalized therapies for treating a patient may be administered based on common tumor mutations. In certain embodiments, common mutations arise in response to treatment and lead to drug resistance. In certain embodiments, the present invention may be used in monitoring patients for cells acquiring a mutation or amplification of cells harboring such drug resistant mutations.

Treatment with various chemotherapeutic agents, particularly with targeted therapies such as tyrosine kinase inhibitors, frequently leads to new mutations in the target molecules that resist the activity of the therapeutic. Multiple strategies to overcome this resistance are being evaluated, including development of second generation therapies that are not affected by these mutations and treatment with multiple agents including those that act downstream of the resistance mutation. In an exemplary embodiment, a common mutation to ibrutinib, a molecule targeting Bruton's Tyrosine Kinase (BTK) and used for CLL and certain lymphomas, is a Cysteine to Serine change at position 481 (BTK/C481S). Erlotinib, which targets the tyrosine kinase domain of the Epidermal Growth Factor Receptor (EGFR), is commonly used in the treatment of lung cancer and resistant tumors invariably develop following therapy. A common mutation found in resistant clones is a threonine to methionine mutation at position 790.

Non-silent mutations shared between populations of cancer patients and common resistant mutations that may be detected with the present invention are known in the art (see e.g., WO/2016/187508). In certain embodiments, drug resistance mutations may be induced by treatment with ibrutinib, erlotinib, imatinib, gefitinib, crizotinib, trastuzumab, vemurafenib, RAF/MEK, check point blockade therapy, or antiestrogen therapy. In certain embodiments, the cancer specific mutations are present in one or more genes encoding a protein selected from the group consisting of Programmed Death-Ligand 1 (PD-L1), androgen receptor (AR), Bruton's Tyrosine Kinase (BTK), Epidermal Growth Factor Receptor (EGFR), BCR-Ab1, c-kit, PIK3CA, HER2, EML4-ALK, KRAS, ALK, ROS1, AKT1, BRAF, MEK1, MEK2, NRAS, RAC1, and ESR1.

Immune checkpoints are inhibitory pathways that slow down or stop immune reactions and prevent excessive tissue damage from uncontrolled activity of immune cells. In certain embodiments, the immune checkpoint targeted is the programmed death-1 (PD-1 or CD279) gene (PDCD1). In other embodiments, the immune checkpoint targeted is cytotoxic T-lymphocyte-associated antigen (CTLA-4). In additional embodiments, the immune checkpoint targeted is another member of the CD28 and CTLA4 Ig superfamily such as BTLA, LAG3, ICOS, PDL1 or KIR. In further additional embodiments, the immune checkpoint targeted is a member of the TNFR superfamily such as CD40, OX40, CD137, GITR, CD27 or TIM-3.

Recently, gene expression in tumors and their microenvironments have been characterized at the single cell level (see e.g., Tirosh, et al. Dissecting the multicellular ecosystem of metastatic melanoma by single cell RNA-seq. Science 352, 189-196, doi:10.1126/science.aad0501 (2016)); Tirosh et al., Single-cell RNA-seq supports a developmental hierarchy in human oligodendroglioma. Nature. 2016 Nov. 10; 539(7628):309-313. doi: 10.1038/nature20123. Epub 2016 Nov. 2; and International patent publication serial number WO 2017004153 A1). In certain embodiments, gene signatures may be detected using the present invention. In one embodiment complement genes are monitored or detected in a tumor microenvironment. In one embodiment MITF and AXL programs are monitored or detected. In one embodiment, a tumor specific stem cell or progenitor cell signature is detected. Such signatures indicate the state of an immune response and state of a tumor. In certain embodiments, the state of a tumor in terms of proliferation, resistance to treatment and abundance of immune cells may be detected.

Thus, in certain embodiments, the invention provides low-cost, rapid, multiplexed cancer detection panels for circulating DNA, such as tumor DNA, particularly for monitoring disease recurrence or the development of common resistance mutations.

Immunotherapy Applications

The embodiments disclosed herein can also be useful in further immunotherapy contexts. For instance, in some embodiments methods of diagnosing, prognosing and/or staging an immune response in a subject comprise detecting a first level of expression, activity and/or function of one or more biomarker and comparing the detected level to a control level wherein a difference in the detected level and the control level indicates that the presence of an immune response in the subject.

In certain embodiments, the present invention may be used to determine dysfunction or activation of tumor infiltrating lymphocytes (TIL). TILs may be isolated from a tumor using known methods. The TILs may be analyzed to determine whether they should be used in adoptive cell transfer therapies. Additionally, chimeric antigen receptor T cells (CAR T cells) may be analyzed for a signature of dysfunction or activation before administering them to a subject. Exemplary signatures for dysfunctional and activated T cell have been described (see e.g., Singer M, et al., A Distinct Gene Module for Dysfunction Uncoupled from Activation in Tumor-Infiltrating T Cells. Cell. 2016 Sep. 8; 166(6): 1500-1511.e9. doi: 10.1016/j.cell.2016.08.052).

In some embodiments, C2c2 is used to evaluate that state of immune cells, such as T cells (e.g., CD8+ and/or CD4+ T cells). In particular, T cell activation and/or dysfunction can be determined, e.g., based on genes or gene signatures associated with one or more of the T cell states. In this way, C2c2 can be used to determine the presence of one or more subpopulations of T cells.

In some embodiments, C2c2 can be used in a diagnostic assay or may be used as a method of determining whether a patient is suitable for administering an immunotherapy or another type of therapy. For example, detection of gene or biomarker signatures may be performed via c2c2 to determine whether a patient is responding to a given treatment or, if the patient is not responding, if this may be due to T cell dysfunction. Such detection is informative regarding the types of therapy the patient is best suited to receive. For example, whether the patient should receive immunotherapy.

In some embodiments, the systems and assays disclosed herein may allow clinicians to identify whether a patient's response to a therapy (e.g., an adoptive cell transfer (ACT) therapy) is due to cell dysfunction, and if it is, levels of up-regulation and down-regulation across the biomarker signature will allow problems to be addressed. For example, if a patient receiving ACT is non-responsive, the cells administered as part of the ACT may be assayed by an assay disclosed herein to determine the relative level of expression of a biomarker signature known to be associated with cell activation and/or dysfunction states. If a particular inhibitory receptor or molecule is up-regulated in the ACT cells, the patient may be treated with an inhibitor of that receptor or molecule. If a particular stimulatory receptor or molecule is down-regulated in the ACT cells, the patient may be treated with an agonist of that receptor or molecule.

In certain example embodiments, the systems, methods, and devices described herein may be used to screen gene signatures that identify a particular cell type, cell phenotype, or cell state. Likewise, through the use of such methods as compressed sensing, the embodiments disclosed herein may be used to detect transcriptomes. Gene expression data are highly structured, such that the expression level of some genes is predictive of the expression level of others. Knowledge that gene expression data are highly structured allows for the assumption that the number of degrees of freedom in the system are small, which allows for assuming that the basis for computation of the relative gene abundances is sparse. It is possible to make several biologically motivated assumptions that allow Applicants to recover the nonlinear interaction terms while under-sampling without having any specific knowledge of which genes are likely to interact. In particular, if Applicants assume that genetic interactions are low rank, sparse, or a combination of these, then the true number of degrees of freedom is small relative to the complete combinatorial expansion, which enables Applicants to infer the full nonlinear landscape with a relatively small number of perturbations. Working around these assumptions, analytical theories of matrix completion and compressed sensing may be used to design under-sampled combinatorial perturbation experiments. In addition, a kernel-learning framework may be used to employ under-sampling by building predictive functions of combinatorial perturbations without directly learning any individual interaction coefficient Compresses sensing provides a way to identify the minimal number of target transcripts to be detected in order obtain a comprehensive gene-expression profile. Methods for compressed sensing are disclosed in PCT/US2016/059230 "Systems and Methods for Determining Relative Abundances of Biomolecules" filed Oct. 27, 2016, which is incorporated herein by reference. Having used methods like compressed sensing to identify a minimal transcript target set, a set of corresponding guide RNAs may then be designed to detect said transcripts. Accordingly, in certain example embodiments, a method for obtaining a gene-expression profile of cell comprises detecting, using the embodiments disclosed, herein a minimal transcript set that provides a gene-expression profile of a cell or population of cells.

Detecting Gene Edits and/or Off-Target Effects

The embodiments disclosed herein may be used in combination with other gene editing tools to confirm that a desired genetic edit or edits were successful and/or to detect the presence of any off-target effects. Cells that have been edited may be screened using one or more guides to one or more target loci. As the embodiments disclosed herein utilize CRISPR systems, theranostic applications are also envisioned. For example, genotyping embodiments disclosed herein may be used to select appropriate target loci or identify cells or populations of cells in needed of the target edit. The same or separate system may then be used to determine editing efficiency. As described in the Working Examples below, the embodiments disclosed herein may be used to design streamlined theranostic pipelines in as little as one week.

Detecting Nucleic Acid Tagged Items

Alternatively, the embodiments described herein may be used to detect nucleic acid identifiers. Nucleic acid identifiers are non-coding nucleic acids that may be used to identify a particular article. Example nucleic acid identifiers, such as DNA watermarks, are described in Heider and Barnekow. "DNA watermarks: A proof of concept" BMC Molecular Biology 9:40 (2008). The nucleic acid identifiers may also be a nucleic acid barcode. A nucleic-acid based barcode is a short sequence of nucleotides (for example, DNA, RNA, or combinations thereof) that is used as an identifier for an associated molecule, such as a target molecule and/or target nucleic acid. A nucleic acid barcode can have a length of at least, for example, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, or 100 nucleotides, and can be in single- or double-stranded form. One or more nucleic acid barcodes can be attached, or "tagged," to a target molecule and/or target nucleic acid. This attachment can be direct (for example, covalent or non-covalent binding of the barcode to the target molecule) or indirect (for example, via an additional molecule, for example, a specific binding agent, such as an antibody (or other protein) or a barcode receiving adaptor (or other nucleic acid molecule). Target molecule and/or target nucleic acids can be labeled with multiple nucleic acid barcodes in combinatorial fashion, such as a nucleic acid barcode concatemer. Typically, a nucleic acid barcode is used to identify target molecules and/or target nucleic acids as being from a particular compartment (for example a discrete volume), having a particular physical property (for example, affinity, length, sequence, etc.), or having been subject to certain treatment conditions. Target molecule and/or target nucleic acid can be associated with multiple nucleic acid barcodes to provide information about all of these features (and more). Methods of generating nucleic acid-barcodes are disclosed, for example, in International Patent Application Publication No. WO/2014/047561.

Enzymes

The application further provides orthologs of C2c2 which demonstrate robust activity making them particularly suitable for different applications of RNA cleavage and detection. These applications include but are not limited to those described herein. More particularly, an ortholog which is demonstrated to have stronger activity than others tested is the C2c2 ortholog identified from the organism *Leptotrichia wadei* (LwC2c2). The application thus provides methods for modifying a target locus of interest, comprising delivering to said locus a non-naturally occurring or engineered composition comprising a C2c2 effector protein, more particularly a C2c2 effector protein with increased activity as described herein and one or more nucleic acid components, wherein at least the one or more nucleic acid components is engineered, the one or more nucleic acid components directs the complex to the target of interest and the effector protein forms a complex with the one or more nucleic acid components and the complex binds to the target locus of interest. In particular embodiments, the target locus of interest comprises RNA. The application further provides for the use of the C2c2 effector proteins with increased activity in RNA sequence specific interference, RNA sequence specific gene regulation, screening of RNA or RNA products or lincRNA or non-coding RNA, or nuclear RNA, or mRNA, mutagenesis, Fluorescence in situ hybridization, or breeding.

The invention is further described in the following examples, which do not limit the scope of the invention described in the claims.

WORKING EXAMPLES

Example 1—General Protocols

Provided are two ways to perform a C2c2 diagnostic test for DNA and RNA. This protocol may also be used with protein detection variants after delivery of the detection aptamers. The first is a two step reaction where amplification and C2c2 detection are done separately. The second is where everything is combined in one reaction and this is called a two-step reaction. It is important to keep in mind that amplification might not be necessary for higher concentration samples so it's good to have a separate C2c2 protocol that doesn't have amplification built in.

CRISPR Effector Only—No Amplificaiton

TABLE 9

| Component | Volume (μL) |
| --- | --- |
| Protein (44 nM final) | 2 |
| crRNA (12 nM final) | 1 |
| background target (100 ng total) | 1 |
| Target RNA (variable) | 1 |
| RNA sensor probe (125 nM) | 4 |
| $MgCl_2$ (6 mM final) | 2 |
| Reaction Buffer 10x | 2 |
| RNAse Inhibitors (murine from NEB) | 2 |
| $H_2O$ | 5 |
| total | 20 |

Reaction buffer is: 40 mM Tris-HCl, 60 mM NaCl, pH 7.3

Perform this reaction for 20 min-3 hrs at 37° C. Read out with excitation: 485 nm/20 nm, emission: 528 nm/20 nm. A signal for single molecule sensitivity may be detected beginning at 20 min but of course sensitivity is higher for longer reaction times.

Two Step Reaction:

TABLE 10

RPA amplification mix

| Component | Volume (μL) |
| --- | --- |
| Primer A (100 μM) | 0.48 |
| Primer B (100 μM) | 0.48 |
| RPA Buffer | 59 |
| MgAc | 5 |
| Target (variable concentration) | 5 |
| ATP (100 μM from NEB kit) | 2 |
| GTP (100 μM from NEB kit) | 2 |
| UTP (100 μM from NEB kit) | 2 |
| CTP (100 μM from NEB kit) | 2 |
| T7 Polymerase (from NEB kit) | 2 |
| $H_2O$ | 25 |
| total | 104.96 |

Mix this reaction together and then re-suspend two to three tubes of freeze-dried enzyme mix). Add 5 μL of 280 mM MgAc to the mix to begin the reaction. Perform reaction for 10-20 min. Each reaction is 20 μL so this is enough for up to five reactions.

TABLE 11

C2c2 detection mix

| Component | Volume (μL) |
| --- | --- |
| Protein (44 nM final) | 2 |
| crRNA (12 nM final) | 1 |
| background target (100 ng total) | 1 |
| RPA reaction | 1 |
| RNA sensor probe (125 nM) | 4 |
| $MgCl_2$ (6 mM final) | 2 |
| Reaction Buffer 10x | 2 |
| RNAse Inhibitors (murine from NEB) | 2 |
| $H_2O$ | 5 |
| total | 20 |

Reaction buffer is: 40 mM Tris-HCl, 60 mM NaCl, pH 7.3

Perform this for 20 min-3 hours. Minimum detection time is about 20 min to see single molecule sensitivity. Performing the reaction for longer only boosts the sensitivity.

TABLE 12

One pot reaction:

| Component | Volume (μL) |
| --- | --- |
| Primer A (100 μM) | 0.48 |
| Primer B (100 μM) | 0.48 |
| RPA Buffer | 59 |
| MgAc | 5 |
| Lw2C2c2 (44 nM final) | 2 |
| crRNA (12 nM final) | 2 |
| Background RNA (from 250 ng/μL) | 2 |
| RNAse alert substr (after resuspending in 20 μL) | 5 |
| murine RNAse inhib from NEB | 10 |
| Target (variable concentration) | 5 |
| ATP (100 μM from NEB kit) | 2 |
| GTP (100 μM from NEB kit) | 2 |
| UTP (100 μM from NEB kit) | 2 |
| CTP (100 μM from NEB kit) | 2 |
| T7 Polymerase (from NEB kit) | 2 |
| $H_2O$ | 4 |
| total | 104.96 |

The NEB kit referenced is the Hi Scribe T7 High Yield Kit. To resuspend buffer, use a 1.5× concentration: resuspend three tubes of freeze dried substrate in 59 μL of buffer and use in the mix above. Each reaction is 20 λL so this is enough for 5 reactions worth. Single molecule sensitivity with this reaction has been observed in as early as 30-40 min.

Example 2—C2C2 from *Leptotrichia wadei* Mediates Highly Sensitive and Specific Detection of DNA and RNA Rapid, inexpensive, and sensitive nucleic acid detection may aid point-of-care pathogen detection, genotyping, and disease monitoring. The RNA-guided, RNA-targeting CRISPR effector Cas13a (previously known as C2c2) exhibits a "collateral effect" of promiscuous RNAse activity upon target recognition. Applicant combined the collateral effect of Cas13a with isothermal amplification to establish a CRISPR-based diagnostic (CRISPR-Dx), providing rapid DNA or RNA detection with attomolar sensitivity and single-base mismatch specificity. Applicant used this Cas13a-based molecular detection platform, termed SHER-LOCK (Specific High Sensitivity Enzymatic Reporter UnLOCKing), to detect specific strains of Zika and Dengue virus, distinguish pathogenic bacteria, genotype human DNA, and identify cell-free tumor DNA mutations. Furthermore, SHERLOCK reaction reagents can be lyophilized for cold-chain independence and long-term storage, and readily reconstituted on paper for field applications.

Figure 17:
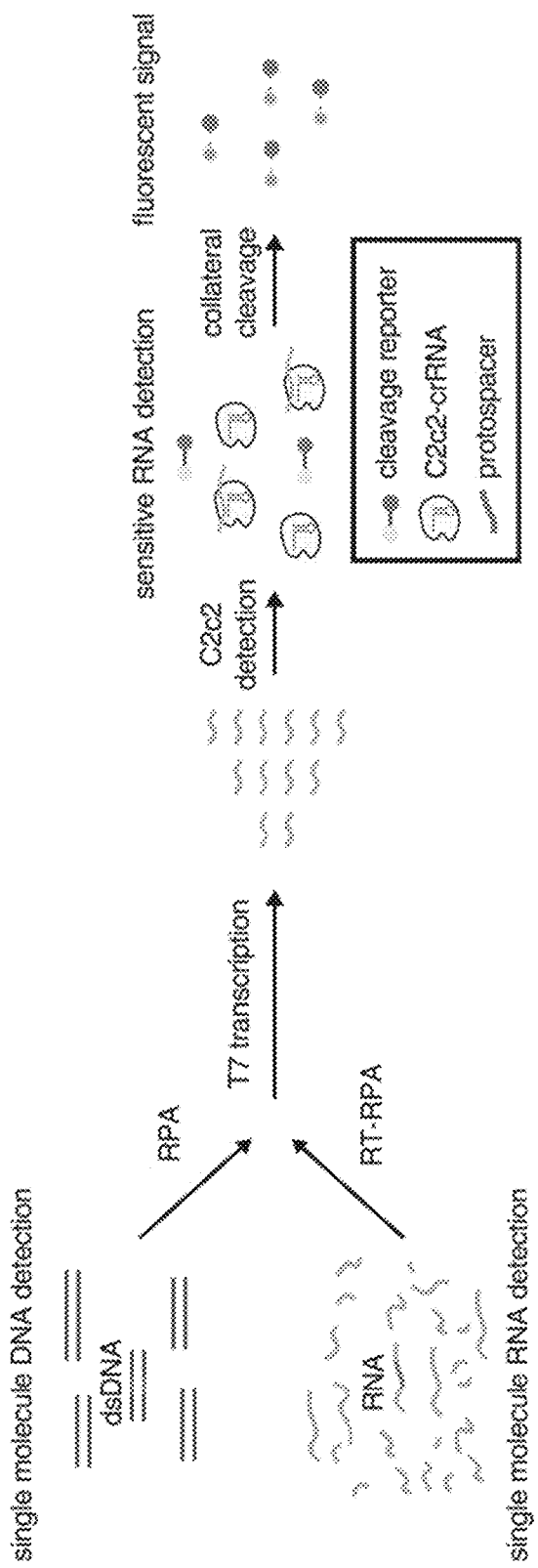
FIG. 17—schematic of SHERLOCK; provides a schematic showing detection of both DNA or RNA targets via incorporation of an RPA or an RT-RPA step accordingly. Upon recognition of target RNA, the collateral effect causes C2c2 to cut the cleavage reporter, generating fluorescence. Single-molecule amounts of RNA or DNA can be amplified to DNA via recombinase polymerase amplification (RPA) and transcribed to produce RNA, which is then detected by C2c2.

The ability to rapidly detect nucleic acids with high sensitivity and single-base specificity on a portable platform may aid in disease diagnosis and monitoring, epidemiology, and general laboratory tasks. Although methods exist for detecting nucleic acids (1-6), they have trade-offs among sensitivity, specificity, simplicity, cost, and speed. Microbial Clustered Regularly Interspaced Short Palindromic Repeats (CRISPR) and CRISPR-associated (CRISPR-Cas) adaptive immune systems contain programmable endonucleases that can be leveraged for CRISPR-based diagnostics (CRISPR-Dx). While some Cas enzymes target DNA (7, 8), single effector RNA-guided RNases, such as Cas13a (previously known as C2c2) (8), can be reprogrammed with CRISPR RNAs (crRNAs) (9-11) to provide a platform for specific RNA sensing. Upon recognition of its RNA target, activated Cas13a engages in "collateral" cleavage of nearby non-targeted RNAs (10). This crRNA-programmed collateral cleavage activity allows Cas13a to detect the presence of a specific RNA in vivo by triggering programmed cell death (10) or in vitro by nonspecific degradation of labeled RNA (10, 12). Here Applicant describes SHERLOCK (Specific High Sensitivity Enzymatic Reporter UnLOCKing), an in vitro nucleic acid detection platform with attomolar sensitivity based on nucleic acid amplification and 3 Cas13a-mediated collateral cleavage of a commercial reporter RNA (12), allowing for real-time detection of the target (FIG. 17).

Methods

Cloning of C2c2 Loci and Proteins for Expression

For the bacterial in vivo efficiency assay, C2c2 proteins from *Leptotrichia wadei* F0279 and *Leptotrichia shahii* were ordered as codon-optimized genes for mammalian expression (Genscript, Jiangsu, China) and cloned into pACYC184 backbones along with the corresponding direct repeats flanking either a beta-lactamase targeting or non-targeting spacer. Spacer expression was driven by a J23119 promoter.

For protein purification, mammalian codon-optimized C2c2 proteins were cloned into bacterial expression vector for protein purification (6x His/Twin Strep SUMO, a pET-based expression vector received as a gift from Ilya Finkelstein).

Bacterial In Vivo C2c2 Efficiency Assay

LwC2c2 and LshC2c2 in vivo efficiency plasmids and a previously described beta-lactamase plasmid (Abudayyeh 2016) were co-transformed into NovaBlue Singles competent cells (Millipore) at 90 ng and 25 ng, respectively. After transformation, dilutions of cells were plated on ampicillin and chloramphenicol LB-agar plate and incubated overnight at 37° C. Colonies were counted the next day.

Nucleic Acid Target and crRNA Preparation

Nucleic acid targets were PCR amplified with KAPA Hifi Hot Start (Kapa Biosystems), gel extracted and purified using MinElute gel extraction kit (Qiagen). Purified dsDNA was incubated with T7 polymerase overnight at 30° C. using the HiScribe T7 Quick High Yield RNA Synthesis kit (New England Biolabs) and RNA was purified with the MEGAclear Transcription Clean-up kit (Thermo Fisher).

For preparation of crRNA, constructs were ordered as DNA (Integrated DNA Technologies) with an appended T7 promoter sequence. crRNA DNA was annealed to a short T7 primer (final concentrations 10 uM) and incubated with T7 polymerase overnight at 37° C. using the HiScribe T7 Quick High Yield RNA Synthesis kit (New England Biolabs). crRNA were purified using RNAXP clean beads (Beckman Coulter) at 2x ratio of beads to reaction volume, with an additional 1.8x supplementation of isopropanol (Sigma).

NASBA Isothermal Amplification

Details of NASBA reaction are described in [Pardee 2016]. For a 20 μL total reaction volume, 6.7 μL of reaction buffer (Life Sciences, NECB-24), 3.3 μL of Nucleotide Mix (Life Sciences, NECN-24), 0.5 μL of nuclease-free water, 0.4 μL of 12.5 μM NASBA primers, 0.1 uL of RNase inhibitor (Roche, 03335402001) and 4 μL of RNA amplicon (or water for the negative control) were assembled at 4° C. and incubated 65° C. for 2 min and then 41° C. for 10 min. 5 μL of enzyme mix (Life Sciences, NEC-1-24) was added to each reaction, and the reaction mixture was incubated at 41° C. for 2 hr. NASBA primers used were 5'-AATTCTAATACGACTCACTATAGGGGGATCCTCTAGAAA- TATGGATT-3' (SEQ ID NO. 16) and 5'-CTCGTATG-TTGTGTGGAATTGT-3' (SEQ ID NO. 17), and the underlined part indicates T7 promoter sequence.

Recombinase Polymerase Amplification

Primers for RPA were designed using NCBI Primer blast (Ye et al., BMC Bioinformatics 13, 134 (2012) using default parameters, with the exception of amplicon size (between 100 and 140 nt), primer melting temperatures (between 54° C. and 67° C.) and primer size (between 30 and 35 nt). Primers were then ordered as DNA (Integrated DNA Technologies).

RPA and RT-RPA reactions run were as instructed with TwistAmp® Basic or TwistAmp® Basic RT (TwistDx), respectively, with the exception that 280 mM MgAc was added prior to the input template. Reactions were run with 1uL of input for 2 hr at 37° C., unless otherwise described.

LwC2c2 Protein Purification

C2c2 bacterial expression vectors were transformed into Rosetta™ 2(DE3) pLysS Singles Competent Cells (Millipore). A 16 mL starter culture was grown in Terrific Broth 4 growth media (12 g/L tryptone, 24 g/L yeast extract, 9.4 g/L K2HPO, 2.2 g/L KH2PO4, Sigma) (TB) was used to inoculate 4L of TB, which was incubated at 37C, 300 RPM until an OD600 of 0.6. At this time, protein expression was induced by supplementation with IPTG (Sigma) to a final concentration of 500 uM, and cells were cooled to 18C for 16 h for protein expression. Cells were then centrifuged at 5200 g, 15 min, 4° C. Cell pellet was harvested and stored at −80° C. for later purification.

All subsequent steps of the protein purification are performed at 4° C. Cell pellet was crushed and resuspended in lysis buffer (20 mM Tris-Hcl, 500 mM NaCl, 1 mM DTT, pH 8.0) supplemented with protease inhibitors (Complete Ultra EDTA-free tablets), lysozyme, and benzonase followed by sonication (Sonifier 450, Branson, Danbury, Conn.) with the following conditions: amplitude of 100 for 1 second on and 2 seconds off with a total sonication time of 10 minutes. Lysate was cleared by centrifugation for 1 hour at 4° C. at 10,000 g and the supernatant was filtered through a Stericup 0.22 micron filter (EMD Millipore). Filtered supernatant was applied to StrepTactin Sepharose (GE) and incubated with rotation for 1 hour followed by washing of the protein-bound StrepTactin resin three times in lysis buffer. The resin was resuspended in SUMO digest buffer (30 mM Tris-HCl, 500 mM NaCl 1 mM DTT, 0.15% Igepal (NP-40), pH 8.0) along with 250 Units of SUMO protease (ThermoFisher) and incubated overnight at 4° C. with rotation. Digestion was confirmed by SDS-PAGE and Coomassie Blue staining and the protein eluate was isolated by spinning the resin down. Protein was loaded onto a 5 mL HiTrap SP HP cation exchange column (GE Healthcare Life Sciences) via FPLC (AKTA PURE, GE Healthcare Life Sciences) and eluted over a salt gradient from 130 mM to 2M NaCl in elution buffer (20 mM Tris-HCl, 1 mM DTT, 5% Glycerol, pH 8.0). The resulting fractions were tested for presence of LwC2c2 by SDS-PAGE and fractions containing the protein were pooled and concentrated via a Centrifugal Filter Unit to 1 mL in S200 buffer (10 mM HEPES, 1M NaCl, 5 mM MgCl2, 2 mM DTT, pH 7.0). The concentrated protein was loaded onto a gel filtration column (Superdex® 200 Increase 10/300 GL, GE Healthcare Life Sciences) via FPLC. The resulting fractions from gel filtration were analyzed by SDS-PAGE and fractions containing LwC2c2 were pooled and buffer exchanged into Storage Buffer (600 mM NaCl, 50 mM Tris-HCl pH 7.5, 5% Glycerol, 2 mM DTT) and frozen at −80 C for storage.

LwC2c2 Collateral Detection

Detection assays were performed with 45 nM purified LwC2c2, 22.5 nM crRNA, 125 nM substrate reporter (Thermo Scientific RNAse Alert v2), 2 µL murine RNase inhibitors, 100 ng of background total RNA and varying amounts of input nucleic acid target, unless otherwise indicated, in nuclease assay buffer (40 mM Tris-HCl, 60 mM NaCl, 6 mM MgCl2, pH 7.3). If the input was amplified DNA including a T7 promoter from a RPA reaction, the above C2c2 reaction was modified to include 1 mM ATP, 1 mM GTP, 1 mM UTP, 1 mM CTP and 0.64, T7 polymerase mix (NEB). Reactions were allowed to proceed for 1-3 hours at 37° C. (unless otherwise indicated) on a fluorescent plate reader (BioTek) with fluorescent kinetics measured every 5 minutes.

The one-pot reaction combining, RPA-DNA amplification, T7 polymerase conversion of DNA to RNA and C2c2 detection was performed by integrating the reaction conditions above with the RPA amplification mix. Briefly, in a 50 µL one-pot assay consisted of 0.48 µM forward primer, 0.48 µM reverse primer, lx RPA rehydration buffer, varying amounts of DNA input, 45 nM LwC2c2 recombinant protein, 22.5 nM crRNA, 250 ng background total RNA, 200 nM substrate reporter (RNase alert v2), 4 uL RNase inhibitor, 2 mM ATP, 2 mM GTP, 2 mM UTP, 2 mM CTP, 1; 11, T7 polymerase mix, 5 mM MgCl2, and 14 mM MgAc.

Quantitative PCR (qPCR) Analysis with TaqMan Probes

To compare SHERLOCK quantification with other established methods, qPCR on a dilution series of ssDNA 1 was performed. A TaqMan probe and primer set (sequences below) were designed against ssDNA 1 and synthesized with IDT. Assays were performed using the TaqMan Fast Advanced Master Mix (Thermo Fisher) and measured on a Roche LightCycler 480.

TABLE 13

Table of qPCR primer/probe sequences.

| Name | Sequence |
| --- | --- |
| Forward Primer | GTG AAA TTG TGA GCG GAT AAA C (SEQ ID NO: 420) |
| Reverse Primer | AAC AGC AAT CTA CTC GAC CTG (SEQ ID NO: 421) |
| TaqMan Probe | /56-FAM/AGGAAACAG/ZEN/CTATGACCATGA TTACGCC/3IABkFQ/ (SEQ ID NOs: 422 and 423) |

Real-Time RPA with SYBR Green II

To compare SHERLOCK quantification with other established methods, Applicant performed RPA on a dilution series of ssDNA 1. To quantitate accumulation of DNA in real-time, Applicant added 1×SYBR Green II (Thermo Fisher) to the typical RPA reaction mixture described above, which provides a fluorescent signal that correlates with the amount of nucleic acid. Reactions were allowed to proceed for 1 hr at 37° C. on a fluorescent plate reader (BioTek) with fluorescent kinetics measured every 5 min.

Lentivirus Preparation and Processing

Lentivirus preparation and processing was based on the previously known methods. Briefly, 10 µg pSB700 derivatives that include a Zika or Dengue RNA fragment, 7.5 µg psPAX2, and 2.5 µg pMD2.G were transfected to HEK293FT cells (Life Technologies, R7007) using the HeBS-CaCl2 method. 28 hr after changing media, DMEM supplemented with 10% FBS, 1% penicillin-streptomycin and 4 mM GlutaMAX (ThermoFisher Scientific), the supernatant was filtered using a 0.45 µm syringe filter. ViralBind Lentivirus Purification Kit (Cell Biolabs, VPK-104) and Lenti-X Concentrator (Clontech, 631231) were used to purify and prepare lentiviruses from the supernatant. Viral concentration was quantified using QuickTiter Lentivirus Kit (Cell Biolabs, VPK-112). Viral samples were spiked into 7% human serum (Sigma, H4522), were heated to 95° C. for 2 min and were used as input to RPA.

Isolation and cDNA Purification of Zika Human Serum Samples

Suspected Zika positive human serum or urine samples were inactivated with AVL buffer (Qiagen) and isolation of RNA was achieved with QIAamp Viral RNA minikit (Qiagen). Isolated RNA was converted into cDNA by mixing random primers, dNTPs, and sample RNA followed by heat denaturation for 7 minutes at 70° C. Denatured RNA was then reverse transcribed with Superscript III (Invitrogen) incubating at 22-25° C. for 10 minutes, 50° C. for 45 minutes, 55° C. for 15 minutes, and 80° C. for 10 minutes. cDNA was then incubated for 20 minutes at 37° C. with RNAse H (New England Biolabs) to destroy RNA in the RNA:cDNA hybrids.

Genomic DNA Extraction from Human Saliva 2 mL of saliva was collected from volunteers, who were restricted from consuming food or drink 30 minutes prior to collection. Samples were then processed using QIAamp® DNA Blood Mini Kit (Qiagen) as recommended by the kit protocol. For boiled saliva samples, 400 µL of phosphate buffered saline (Sigma) was added to 100 µL of volunteer saliva and centrifuged for 5 min at 1800 g. The supernatant was decanted and the pellet was resuspended in phosphate buffered saline with 0.2% Triton X-100 (Sigma) before incubation at 95° C. for 5 min. 1 µL of sample was used as direct input into RPA reactions.

Freeze-Drying and Paper Deposition

A glass fiber filter paper (Whatman, 1827-021) was autoclaved for 90 min (Consolidated Stills and Sterilizers, MKII) and was blocked in 5% nuclease-free BSA (EMD Millipore, 126609-10GM) overnight. After rinsing the papers once with nuclease-free water (Life technologies, AM9932), they were incubated with 4% RNAsecure™ (Life technologies, AM7006) at 60° C. for 20 min and were rinsed three more times with the nuclease-free water. Treated papers were dried for 20 min at 80° C. on a hot plate (Cole-Parmer, IKA C-Mag HS7) prior to use. 1.8 µL of C2c2 reaction mixture as indicated earlier was put onto the disc (2 mm) that was placed in black, clear bottom 384-well plate (Corning, 3544). For the freeze-dried test, the plate containing reaction mixture discs was flash frozen in liquid nitrogen and was freeze-dried overnight as described in Pardee et al (2). RPA samples were diluted 1:10 in nuclease-free water, and 1.8 µL of the mixture was loaded onto the paper discs and incubated at 37° C. using a plate reader (BioTek Neo).

Bacterial Genomic DNA Extraction

For experiments involving CRE detection, bacterial cultures were grown in lysogeny broth (LB) to mid-log phase, then pelleted and subjected to gDNA extraction and purification using the Qiagen DNeasy Blood and Tissue Kit, using the manufacturer's protocol for either Gram negative or Gram positive bacteria, as appropriate. gDNA was quantified by the Quant-It dsDNA assay on a Qubit fluorometer and its quality assessed via 200-300 nm absorbance spectrum on a Nanodrop spectrophotometer.

For experiments discriminating between *E. coli* and *P. aeruginosa*, bacterial cultures were grown to early stationary phase in Luria-Bertani (LB) broth. 1.0 mL of both *E. coli* and *P. aeruginosa* were processed using the portable Pure-Lyse bacteria gDNA extraction kit (Claremont BioSolutions). 1× binding buffer was added to the bacterial culture before passing through the battery-powered lysis cartridge for three minutes. 0.5X binding buffer in water was used as a wash solution before eluting with 150 μL of water.

Digital Droplet PCR Quantification

To confirm the concentration of ssDNA 1 and ssRNA 1, standard dilutions were used. Applicant performed digital-droplet PCR (ddPCR). For DNA quantification, droplets were made using the ddPCR Supermix for Probes (no dUTP) with PrimeTime qPCR probes/primer assays designed to target the ssDNA 1 sequence. For RNA quantification, droplets were made using the one-step RT-ddPCR kit for probes with PrimeTime qPCR probes/primer assays designed to target the ssRNA 1 sequence. Droplets were generated in either case using the QX200 droplet generator (Bio-Rad) and transferred to a PCR plate. Droplet-based amplification was performed on a thermocycler as described in the kit's protocol and nucleic acid concentrations were subsequently determined via measurement on a QX200 droplet reader.

Synthetic Standards for Human Genotyping

To create standards for accurate calling of human sample genotypes, Applicant designed primers around the SNP target to amplify ~200 bp regions from human genomic DNA representing each of the two homozygous genotypes. The heterozygous standard was then made by mixing the homozygous standards in a 1:1 ratio. These standards were then diluted to equivalent genome concentrations (~0.56 fg/μL) and used as input for SHERLOCK alongside real human samples.

Detection of Tumor Mutant Cell Free-DNA (cfDNA)

Mock cfDNA standards simulating actual patient cfDNA samples were purchased from a commercial vendor (Horizon Discovery Group). These standards were provided as four allelic fractions (100% WT and 0.1%, 1%, and 5% mutant) for both the BRAF V600E and EGFR L858R mutants. 3 μL of these standards were provided as input to SHERLOCK.

Analysis of Fluorescence Data

To calculate background subtracted fluorescence data, the initial fluorescence of samples was subtracted to allow for comparisons between different conditions. Fluorescence for background conditions (either no input or no crRNA conditions) were subtracted from samples to generate background subtracted fluorescence.

Guide ratios for SNP or strain discrimination were calculated by dividing each guide by the sum of guide values, to adjust for sample-to-sample overall variation. crRNA ratios for SNP or strain discrimination were calculated to adjust for sample-to-sample overall variation as follows:

$$\text{crRNA } A_i \text{ ratio} = \frac{(m+n)A_i}{\sum_{i=1}^{m} A_i + \sum_{i=1}^{n} B_i}$$

where $A_i$ and $B_i$ refer to the SHERLOCK intensity values for technical replicate i of the crRNAs sensing allele A or allele B, respectively, for a given individual. Since an assay typically has four technical replicates per crRNA, m and n are equal to 4 and the denominator is equivalent to the sum of all eight of the crRNA SHERLOCK intensity values for a given SNP locus and individual. Because there are two crRNAs, the crRNA ratio average across each of the crRNAs for an individual will always sum to two. Therefore, in the ideal case of homozygosity, the mean crRNA ratio for the positive allele crRNA will be two and the mean crRNA ratio for the negative allele crRNA will be zero. In the ideal case of heterozygosity, the mean crRNA ratio for each of the two crRNAs will be one.

Characterization of LwCas13a Cleavage Requirements.

The protospacer flanking site (PFS) is a specific motif present near the target site that is required for robust ribonuclease activity by Cas13a. The PFS is located at the 3' end of the target site and was previously characterized for LshCas13a by our group as H (not G) (1). Although this motif is akin to a protospacer adjacent motif (PAM), a sequence restriction for DNA targeting Class 2 systems, it is functionally different as it not involved in preventing self targeting of CRISPR loci in endogenous systems. Future structural studies of Cas13a will likely elucidate the importance of the PFS for Cas13a:crRNA target complex formation and cleavage activity.

Figure 2A:
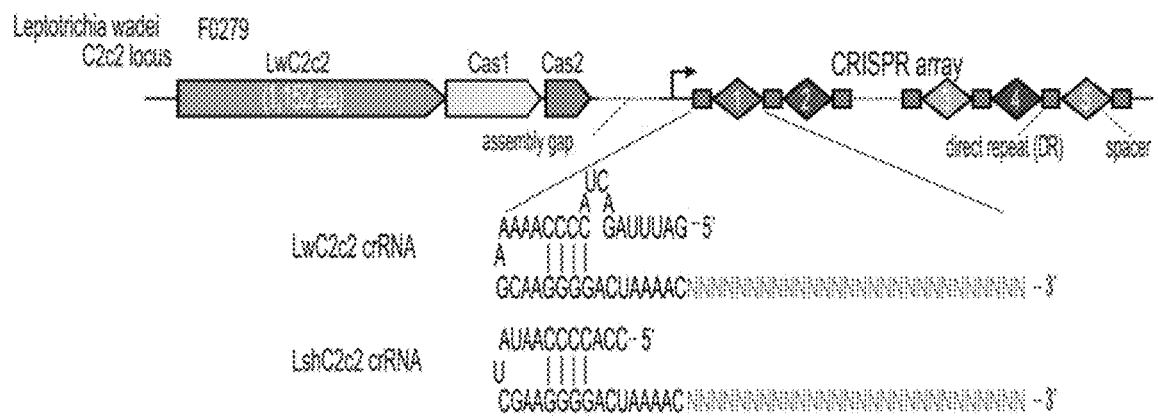
FIG. 2A—provides schematic of the CRISPR/C2c2 locus from *Leptotrichia wadei*. Representative crRNA structures from LwC2c2 and LshC2c2 systems are shown. (SEQ. I.D. Nos. 142 and 143) FIG. 2B. Schematic of in vivo bacterial assay for C2c2 activity. A protospacer is cloned upstream of the beta-lactamase gene in an ampicillin-resistance plasmid, and this construct is transformed into E. coli expressing C2c2 in conjunction with either a targeting or non-targeting spacer. Successful transformants are counted to quantify activity.
Figure 2B:
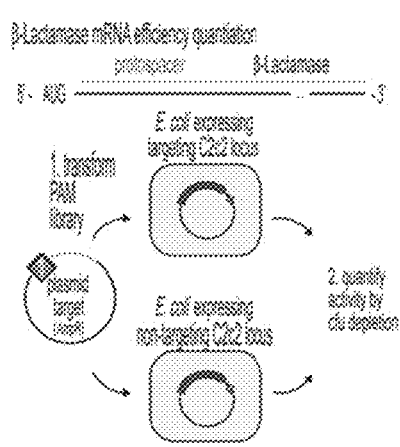
FIG. 2C. Quantitation of LwC2c2 and LshC2c2 in vivo activity. (n=2 biological replicates; bars represent mean±s.e.m.) FIG. 2D. Final size exclusion gel filtration of LwC2c2.
FIG. 2E. Coomassie blue stained acrylamide gel of LwC2c2 stepwise purification.
FIG. 2F. Activity of LwC2c2 against different PFS targets. LwC2c2 was targeted against fluorescent RNA with variable 3' PFS flanking the spacer, and reaction products were visualized on denaturing gel. LwC2c2 shows a slight preference against G PFS.
Figure 2C:
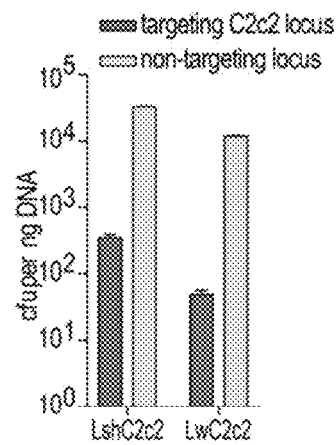
Figure 2D:
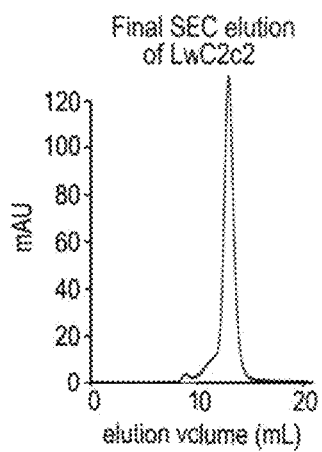
Figure 2E:
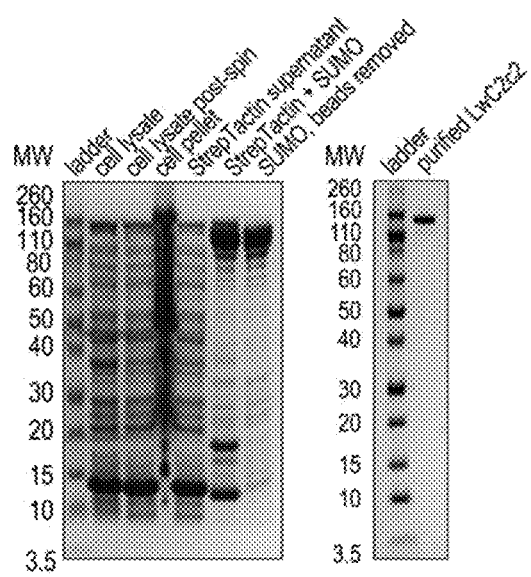
Figure 2F:
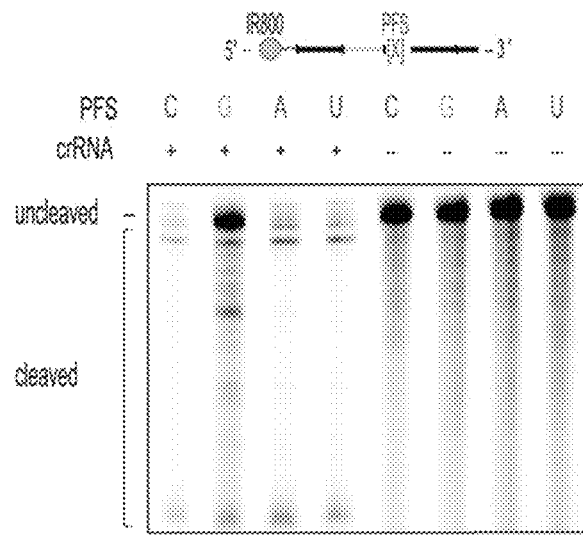
Figure 3:
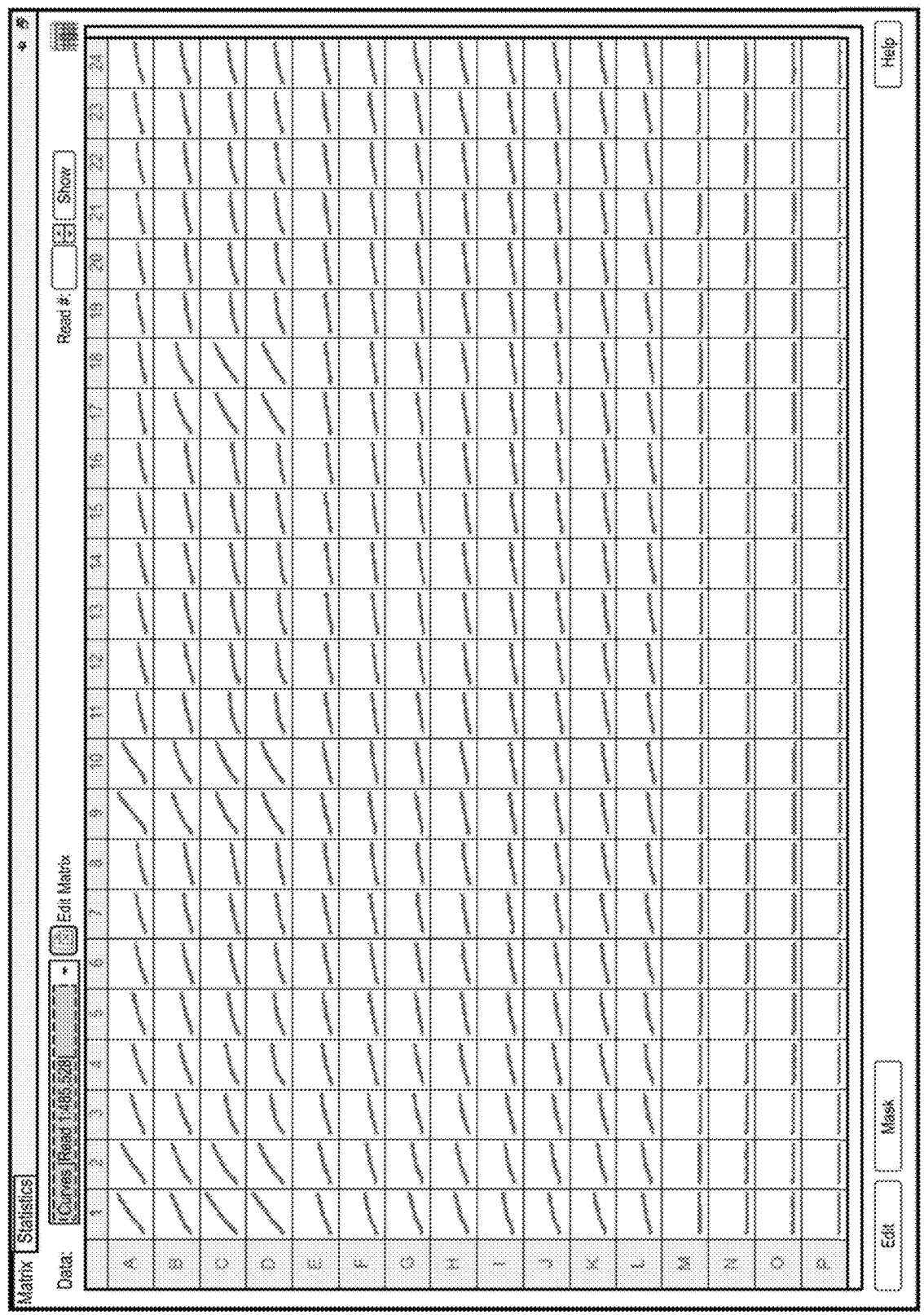
FIG. 3—Shows detection of an example masking construct at different dilutions using 1 μg, 100 ng, 10 ng, and 1 ng of target with 4 different amounts of protein/crRNA (1:4, 1:16, 1:32, 1:64) with 2 pools of crRNAs, no crRNA condition, technical duplicates, in (96+48)*2=288 reactions, measured in 5 min interval over 3 hours.
Figure 4:
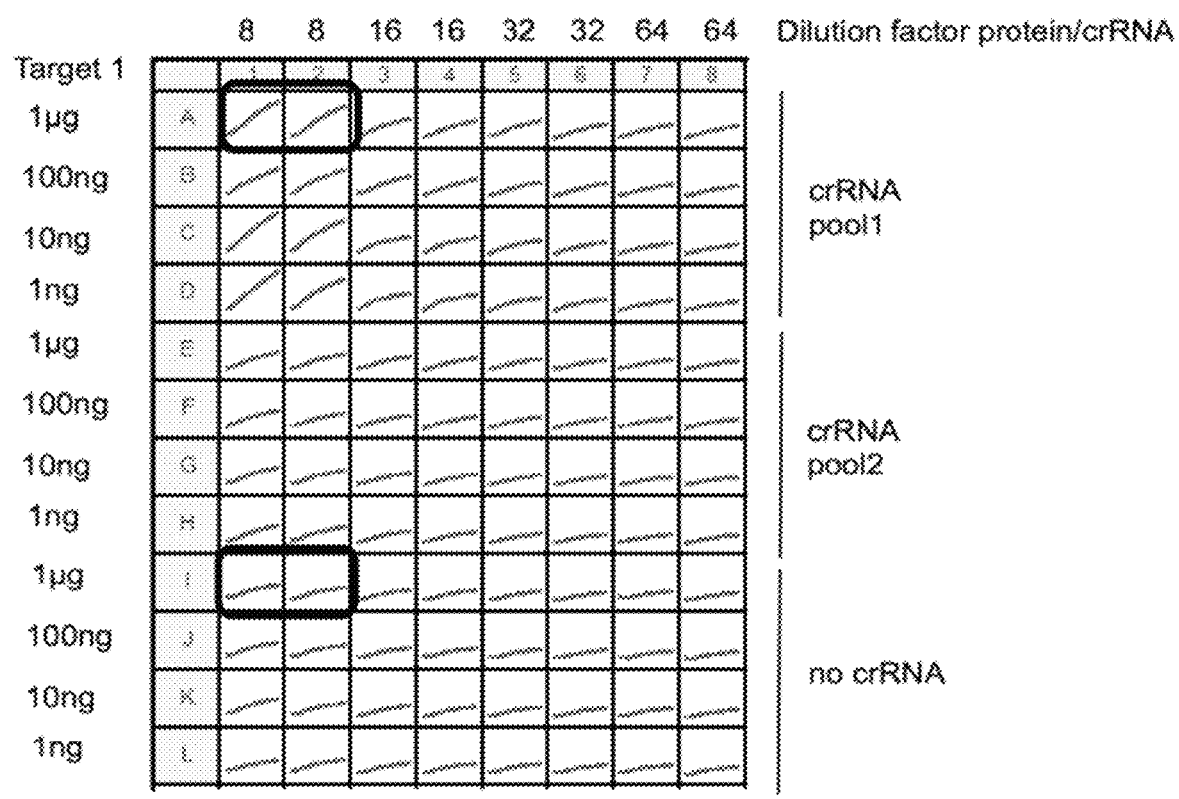
FIG. 4—Shows detection of an example masking construct at different dilutions using 1 μg, 100 ng, 10 ng, and 1 ng of target with 4 different amounts of protein/crRNA (1:4, 1:16, 1:32, 1:64) with 2 pools of crRNAs, no crRNA condition, technical duplicates, in (96+48)*2=288 reactions, measured in 5 min interval over 3 hours.
Figure 5:
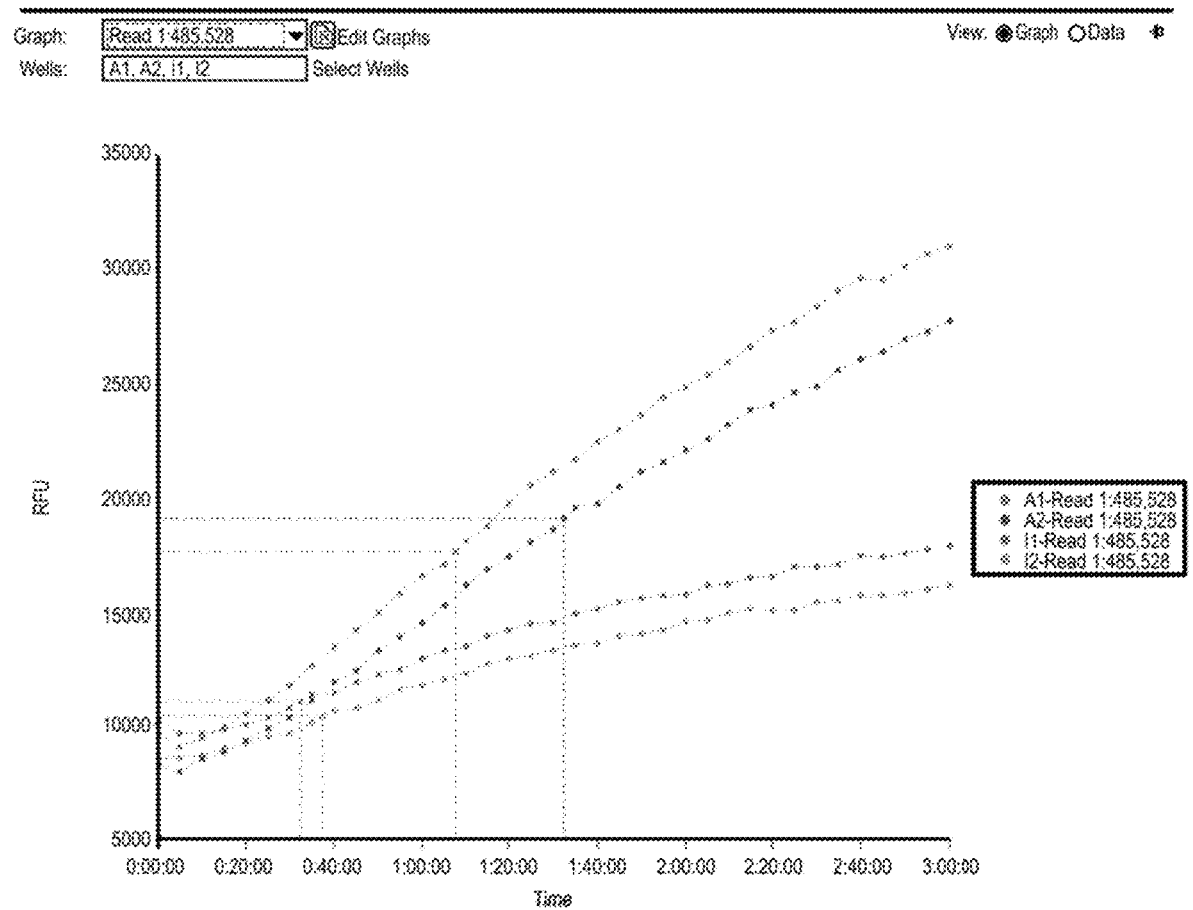
FIG. 5—Shows detection of an example masking construct at different dilutions using 1 μg, 100 ng, 10 ng, and 1 ng of target with 4 different amounts of protein/crRNA (1:4, 1:16, 1:32, 1:64) with 2 pools of crRNAs, no crRNA condition, technical duplicates, in (96+48)*2=288 reactions, measured in 5 min interval over 3 hours.
Figure 6:
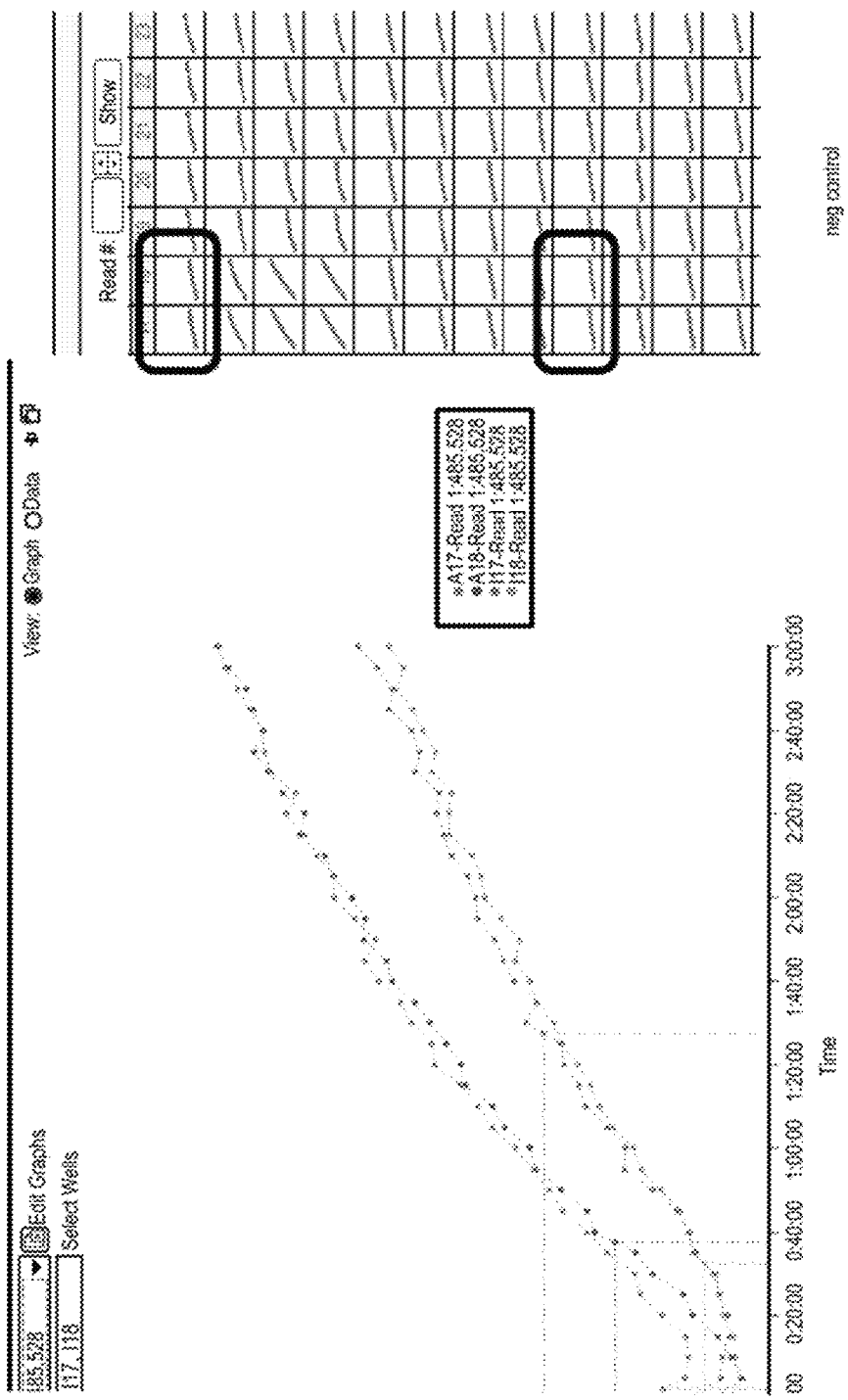
FIG. 6—Shows detection of an example masking construct at different dilutions using 1 μg, 100 ng, 10 ng, and 1 ng of target with 4 different amounts of protein/crRNA (1:4, 1:16, 1:32, 1:64) with 2 pools of crRNAs, no crRNA condition, technical duplicates, in (96+48)*2=288 reactions, measured in 5 min interval over 3 hours.
Figure 7:
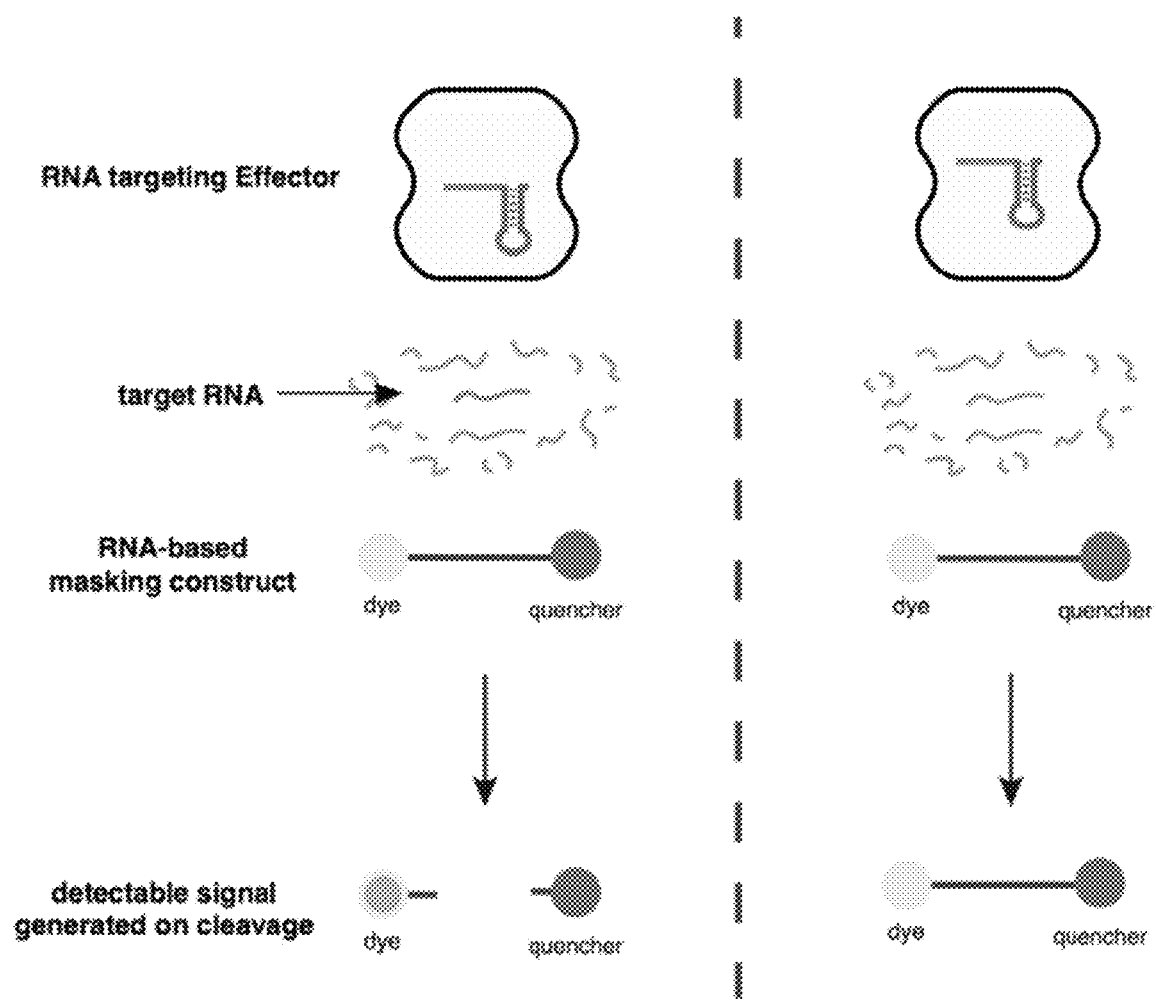
FIG. 7—provides a schematic of an example detection scheme using a masking construct and CRISPR effector protein, in accordance with certain example embodiments.
Figure 8:
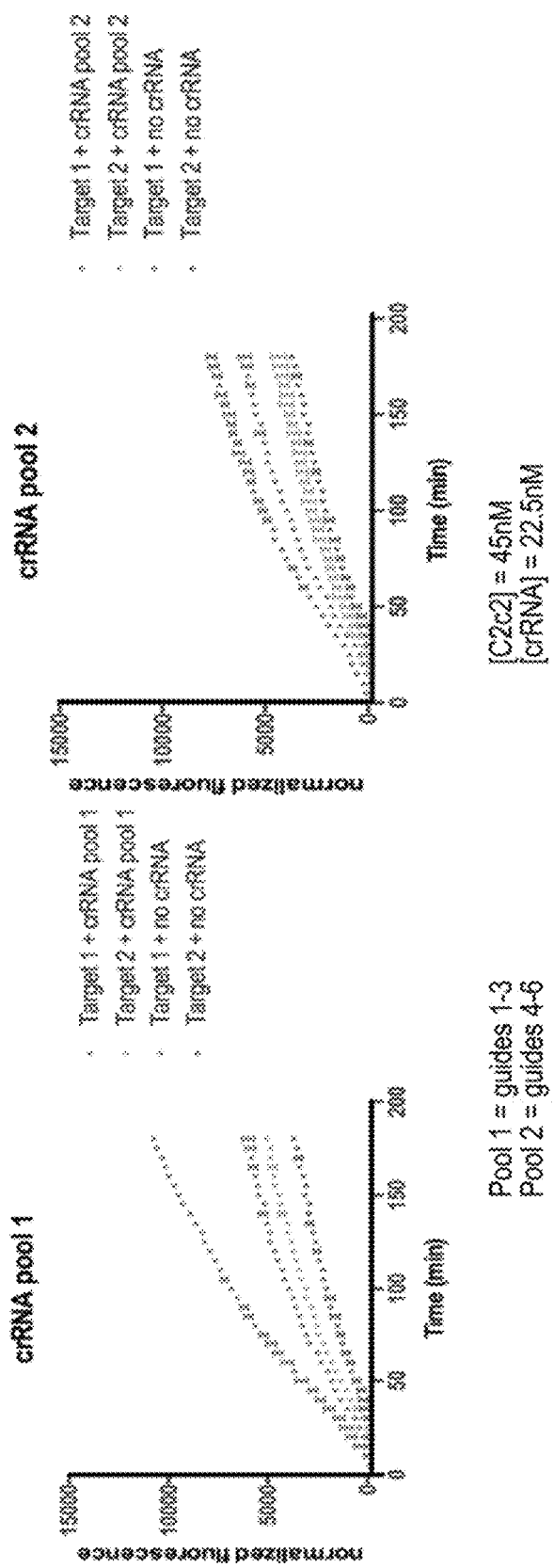
FIG. 8—provides a set of graphs showing changes in fluorescence over time when detecting a target using different pools of guide RNAs.
Figure 9:
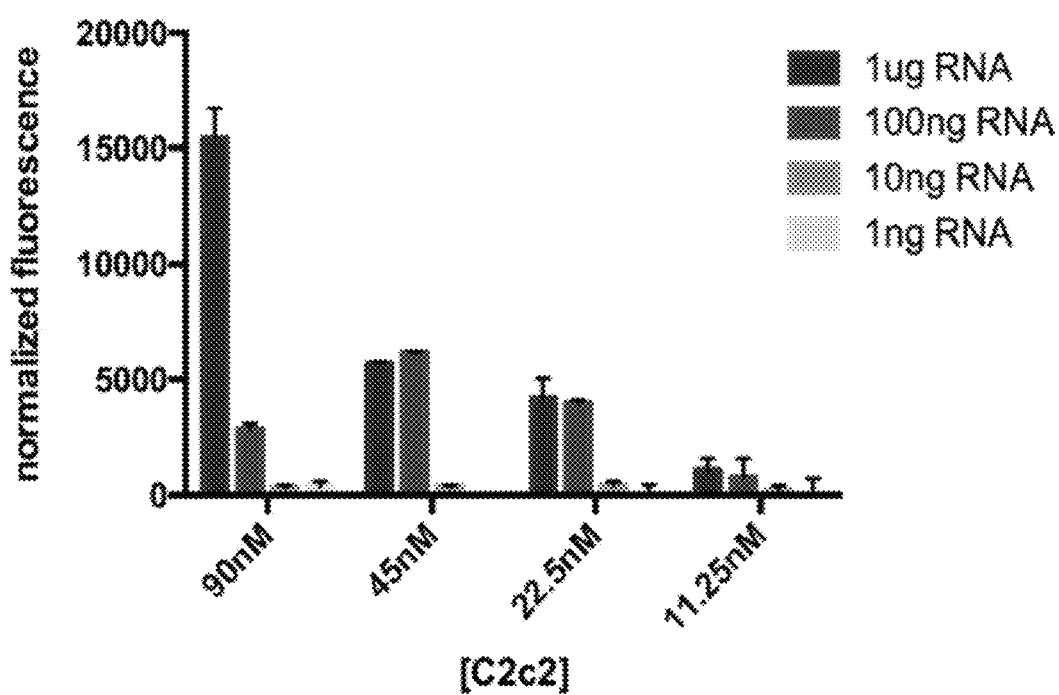
FIG. 9—provides a graph showing the normalized fluorescence detected across different dilutions of target RNA at varying concentrations of CRISPR effector protein.

Applicant purified the recombinant LwCas13a protein from *E. coli* (FIGS. 2D-2E) and assayed its ability to cleave a 173-nt ssRNA with each possible protospacer flanking site (PFS) nucleotide (A, U, C or G) (FIG. 2F). Similar to LshCas13a, LwCas13a can robustly cleave a target with A, U, or C PFS, with less activity on the ssRNA with a G PFS. Although weaker activity against ssRNA 1 with a G PFS was observed, Applicant still saw robust detection for the two target sites with G PFS motifs (Table 3; rs601338 crRNA and Zika targeting crRNA 2). It is likely that the H PFS is not required under every circumstance and that in many cases strong cleavage or collateral activity can be achieved with a G PFS.

Discussion of Recombinase Polymerase Amplification (RPA) and Other Isothermal Amplification Strategies.

Recombinase polymerase amplification (RPA) is an isothermal amplification technique consisting of three essential enzymes: a recombinase, single-stranded DNA-binding proteins (SSBs), and a strand displacing polymerase. RPA overcomes many technical difficulties present in other amplification strategies, particularly polymerase chain reaction (PCR), by not requiring temperature regulation as the enzymes all operate at a constant temperature around 37° C. RPA replaces temperature cycling for global melting of the double-stranded template and primer annealing with an enzymatic approach inspired by in vivo DNA replication and repair. Recombinase-primer complexes scan double-stranded DNA and facilitate strand exchange at complementary sites. The strand exchange is stabilized by SSBs, allowing the primer to stay bound. Spontaneous disassembly of the recombinase occurs in its ADP-bound state, allowing a strand-displacing polymerase to invade and extend the primer, allowing amplification without complex instrumentation unavailable in point-of-care and field settings. Cyclic repetition of this process in a temperate range of 37-42° C. results in exponential DNA amplification. The original formulation published uses the *Bacillus subtilis* Pol I (Bsu) as the strand-displacing polymerase, T4 uvsX as the recombinase, and T4 gp32 as the single-stranded DNA binding protein (2), although it is unclear what components are in the current formulation sold by TwistDx used in this study.

Figure 15:
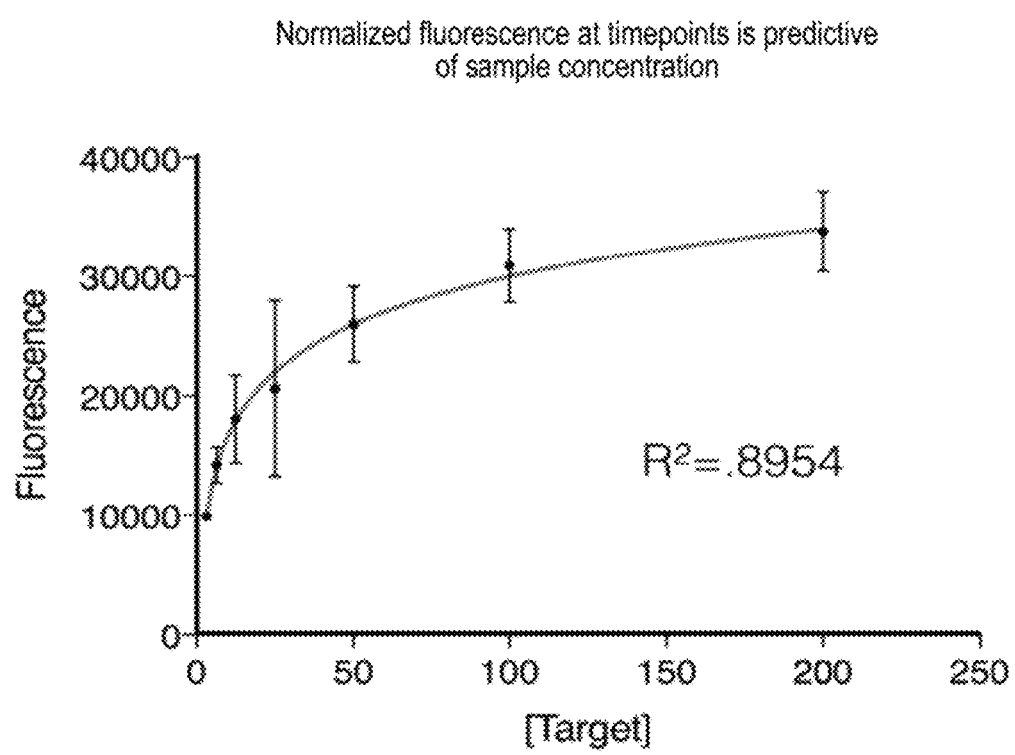
FIG. 15—Shows that normalized fluorescence at particular time points is predictive of sample input concentration. Fluorescence measurements from Cas13a detection without amplification are correlated with input RNA concentration. (n=2 biological replicates; bars represent mean±s.e.m.).
Figure 16:
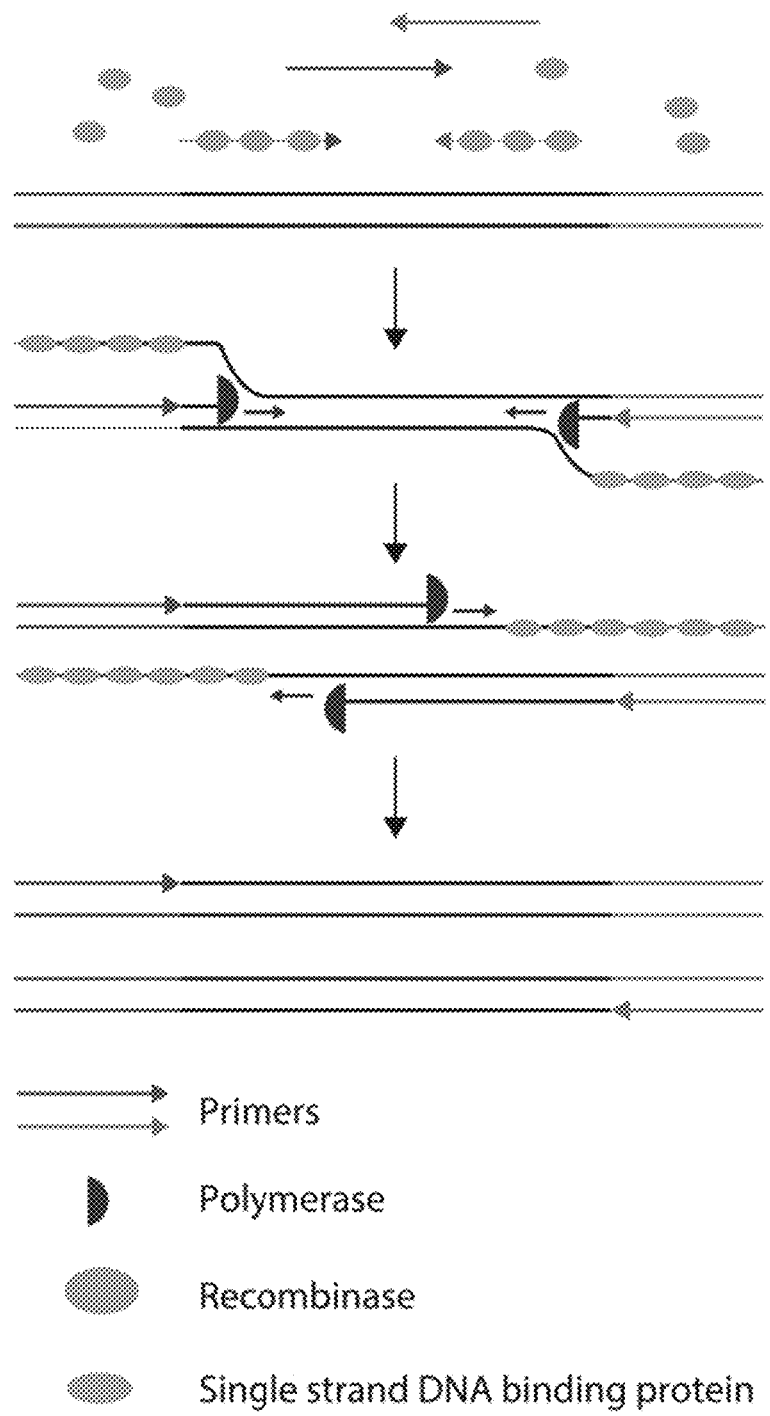
FIG. 16—provides a schematic of the RPA reaction, showing the participating components in the reaction.

Additionally, RPA has a number of limitations:
1) Although Cas13a detection is quantitative (FIG. 15), real-time RPA quantitation can be difficult because of its rapid saturation when the recombinase uses all available ATP. While real-time PCR is quantitative because of the ability to cycle amplification, RPA has no mechanism to tightly control the rate of amplification. Certain adjustments can be made to reduce amplification speed, such as reducing available magnesium or primer concentrations, lowering the reaction temperature, or designing inefficient primers. Although some instances of quantitative SHERLOCK are observed, such as in FIGS. 31A-31D, 32A, 32B, 52A and 52B, it is not always the case and may depend on the template.
2) RPA efficiency can be sensitive to primer design. The manufacturer typically recommends designing longer primers to ensure efficient recombinase binding with average GC content (40-60%) and screening up to 100 primer pairs to find highly sensitive primer pairs. Applicant has found with SHERLOCK that only two primer pairs have to be designed to achieve an attomolar test with single molecule sensitivity. This robustness is likely due to the additional amplification of signal by constitutively active Cas13a collateral activity that offsets any inefficiencies in amplicon amplification. This quality is particularly important for our bacterial pathogen identification in FIGS. 34A-34C. Issues were experienced with amplifying highly structured regions such as the 16S rRNA gene sites in bacterial genomes because there is no melting step involved in RPA. Thus, secondary structure in primers becomes an issue, limiting amplification efficiency and thus sensitivity. The embodiments disclosed herein were believed to be successful despite these RPA-specific issues because of additional signal amplification from Cas13a.
3) The amplification sequence length must be short (100-200 bp) for efficient RPA. For most applications, this is not a significant issue and perhaps is even advantageous (e.g. cfDNA detection where average fragment size is 160 bp). Sometimes large amplicon lengths are important, such as when universal primers are desired for bacterial detection and the SNPs for discrimination are spread over a large area.

Figure 10:
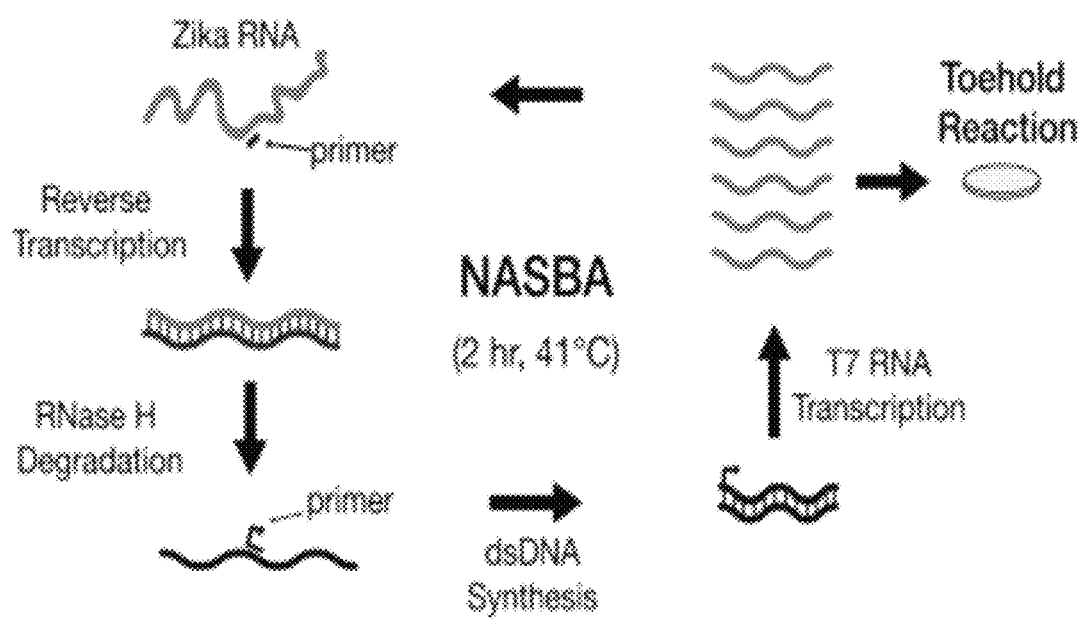
FIG. 10—is a schematic showing the general steps of a NASBA amplification reaction.
Figure 11:
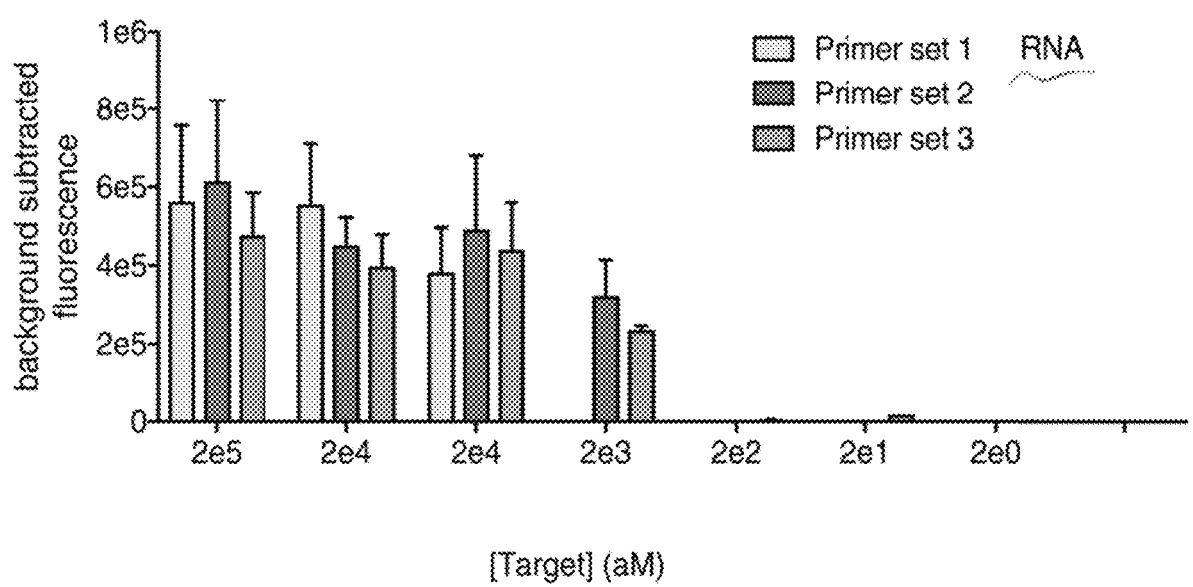
FIG. 11—provides a graph showing detection of nucleic acid target ssRNA 1 amplified by NASBA with three different primer sets and then subjected to C2c2 collateral detection using a quenched fluorescent probe. (n=2 technical replicates; bars represent mean±s.e.m.)
Figure 12:
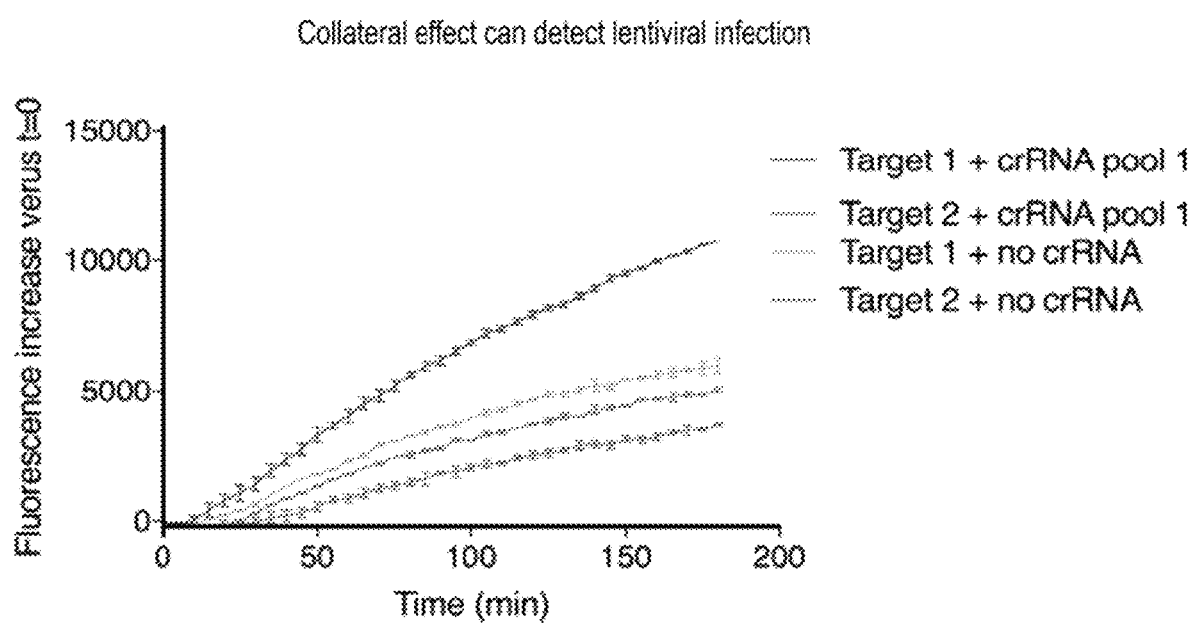
FIG. 12—provides a graph showing that the collateral effect may be used to detect the presence of a lentiviral target RNA.
Figure 13:
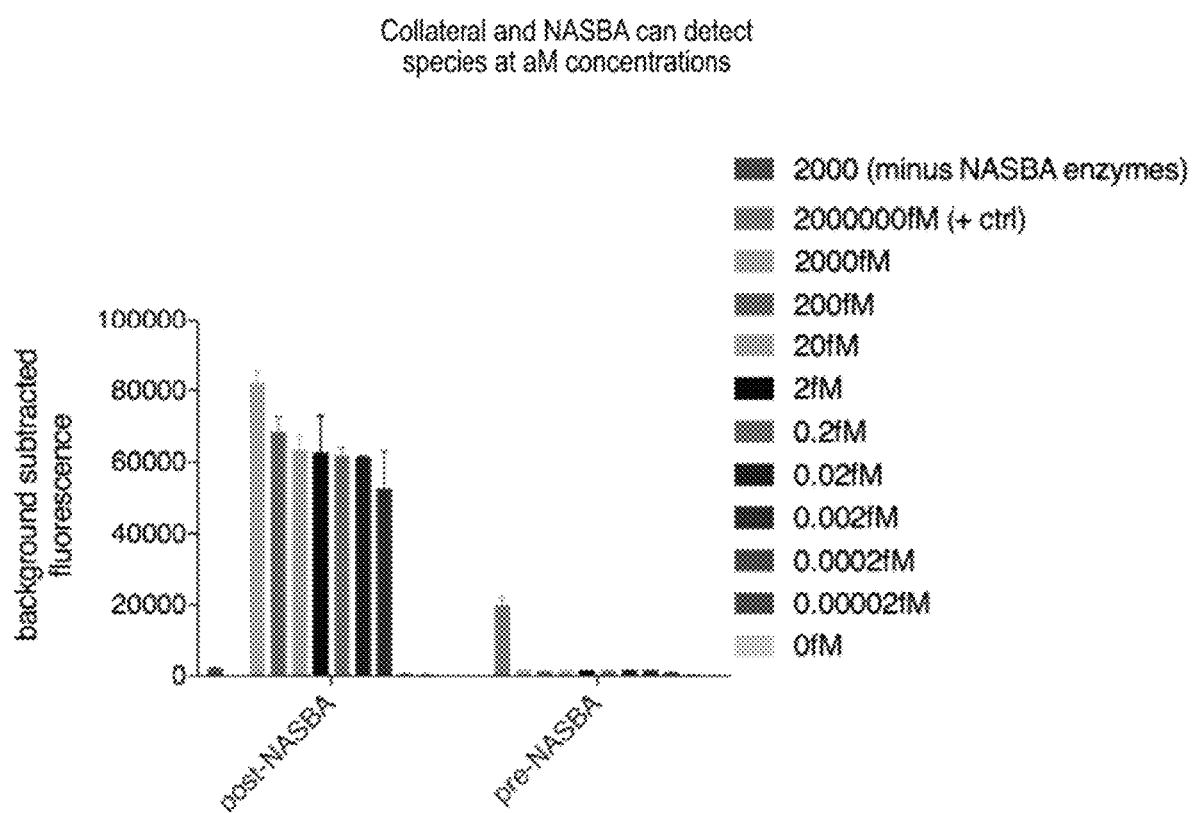
FIG. 13—provides a graph demonstrating that the collateral effect and NASBA can detect species at aM concentrations.
Figure 14:
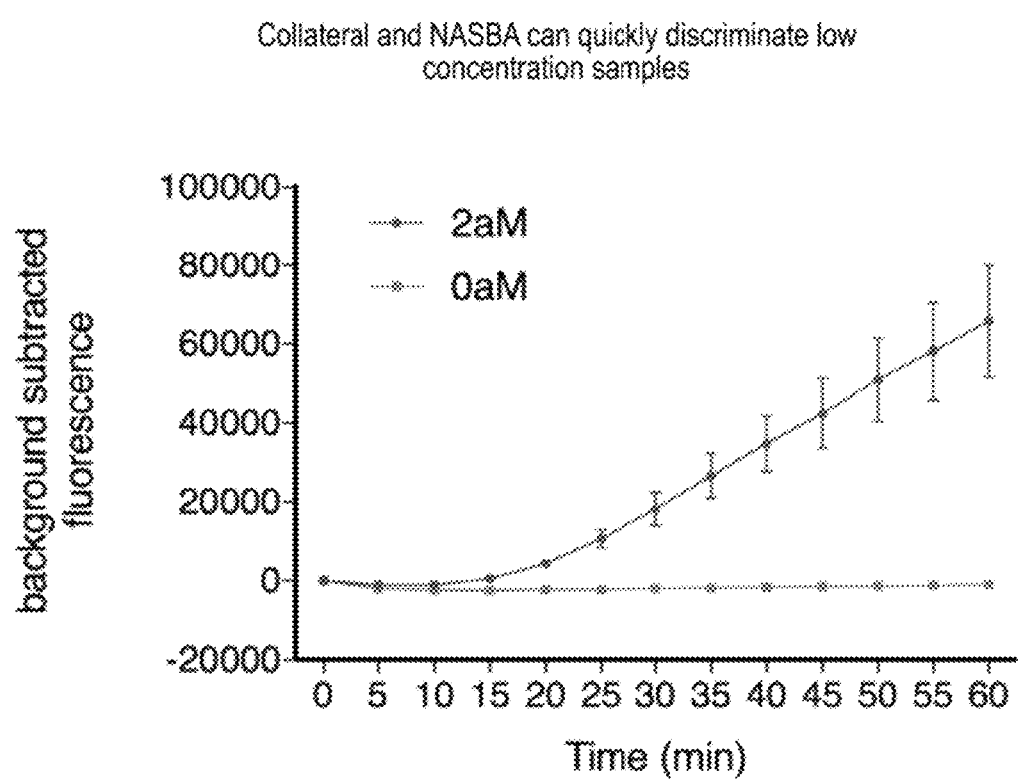
FIG. 14—provides a graph demonstrating that the collateral effect and NASBA quickly discriminate low concentration samples.
Figure 53:
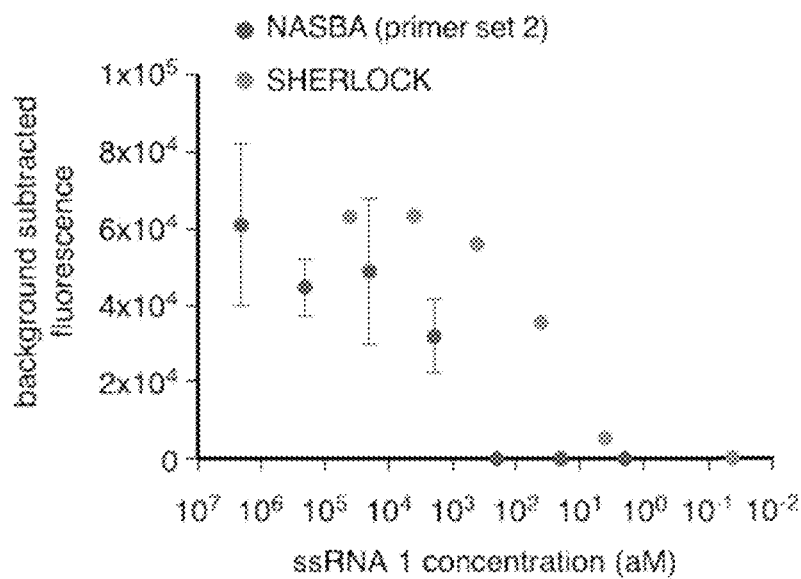
FIG. 53—Comparison of detection of ssRNA 1 by NASBA with primer set 2 (of FIG. 11) and SHERLOCK. (n=2 technical replicates; bars represent mean±s.e.m.)

SHERLOCK's modularity allows any amplification technique, even non-isothermal approaches, to be used prior to T7 transcription and Cas13a detection. This modularity is enabled by the compatibility of the T7 and Cas13a steps in a single reaction allowing detection to be performed on any amplified DNA input that has a T7 promoter. Prior to using RPA, nucleic acid sequence based amplification (NASBA) (3, 4) was attempted for our detection assay (FIG. 10). However NASBA did not drastically improve the sensitivity of Cas13a (FIGS. 11 and 53). Other amplification techniques that could be employed prior to detection include PCR, loop mediated isothermal amplification (LAMP) (5), strand displacement amplification (SDA) (6), helicase-dependent amplification (HDA) (7), and nicking enzyme amplification reaction (NEAR) (8). The ability to swap any isothermal technique allows SHERLOCK to overcome the specific limitations of any one amplification technique.

Design of Engineered Mismatches.

Applicant demonstrates that LshCas13a target cleavage was reduced when there were two or more mismatches in the target:crRNA duplex but was relatively unaffected by single mismatches, an observation Applicant confirmed for LwCas13a collateral cleavage (FIG. 36A). Applicant hypothesized that by introducing an additional mutation in the crRNA spacer sequence, Applicant would destabilize collateral cleavage against a target with an additional mismatch (two mismatches in total) while retaining on-target collateral cleavage, as there would only be a single mismatch. To test the possibility of engineering increased specificity, Applicant designed multiple crRNAs targeting ssRNA 1 and included mismatches across the length of the crRNA (FIG. 36A) to optimize on-target collateral cleavage and minimize collateral cleavage of a target that differs by a single mismatch. Applicant observed that these mismatches did not reduce collateral cleavage of ssRNA 1, but significantly decreased signal for a target that included an additional mismatch (ssRNA 2). The designed crRNA that best distinguished between ssRNA 1 and 2 included synthetic mismatches close to the ssRNA 2 mismatch, in effect creating a "bubble," or distortion in the hybridized RNA. The loss of sensitivity caused by the coordination of a synthetic mismatch and an additional mismatch present in the target (i.e., a double mismatch) agrees with the sensitivity of LshCas13a and LwCas13a to consecutive or nearby double mismatches and presents a basis for rational design of crRNAs that enable single-nucleotide distinction (FIG. 36B).

Figure 37A:
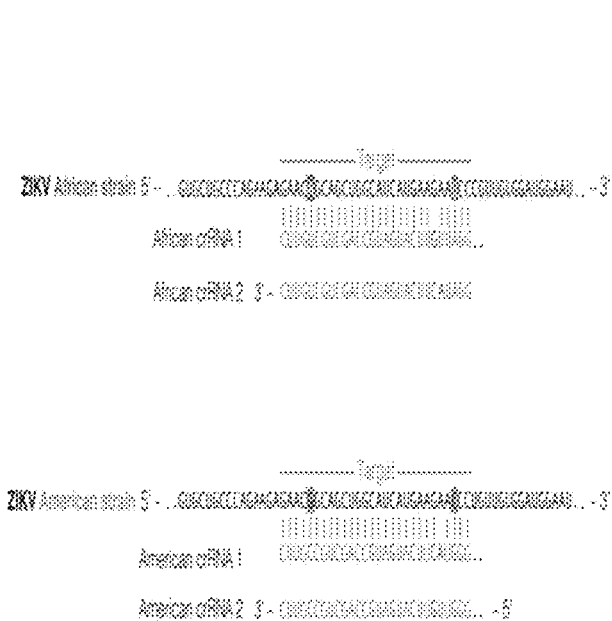
FIG. 37A shows schematics of Zika virus African strain American strain target regions and the crRNA sequences used for detection (SEQ. I.D. Nos. 165 through 170). SNPs in the target are highlighted red or blue and synthetic mismatches in the guide sequence are colored red.
Figure 37B:
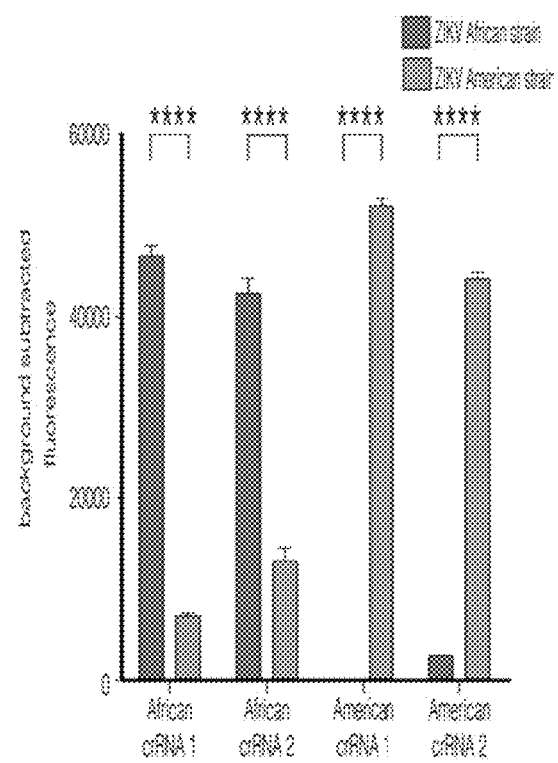
FIG. 37B is a graph showing that highly specific detection of strain SNPs allows for the differentiation of Zika African versus American RNA targets using SHERLOCK (n=2 technical replicates, two-tailed Student t-test; **, p<0.0001; bars represent mean±s.e.m.) (SEQ. I.D. Nos. 171 through 176).
Figure 58B:
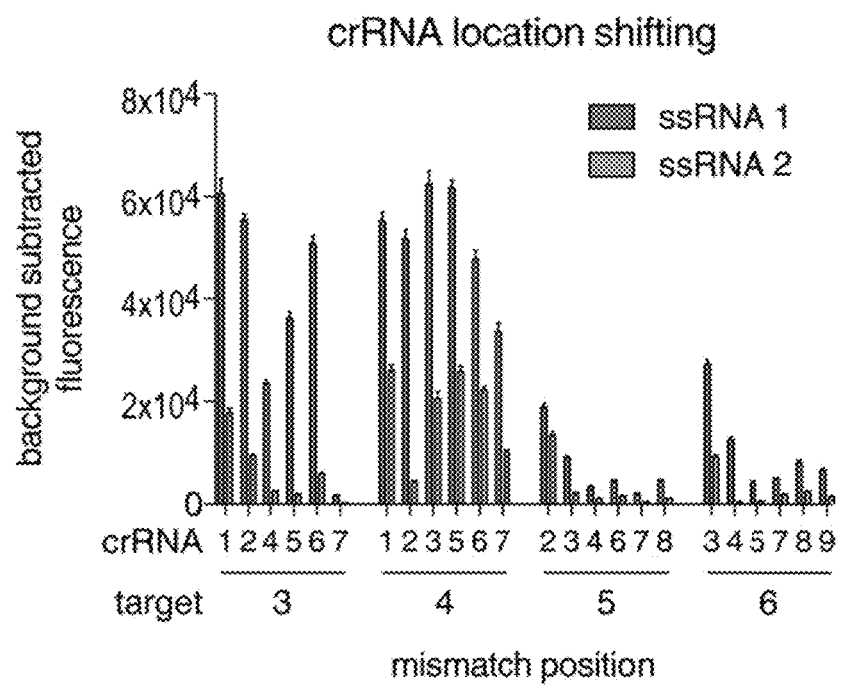
Figure 58C:
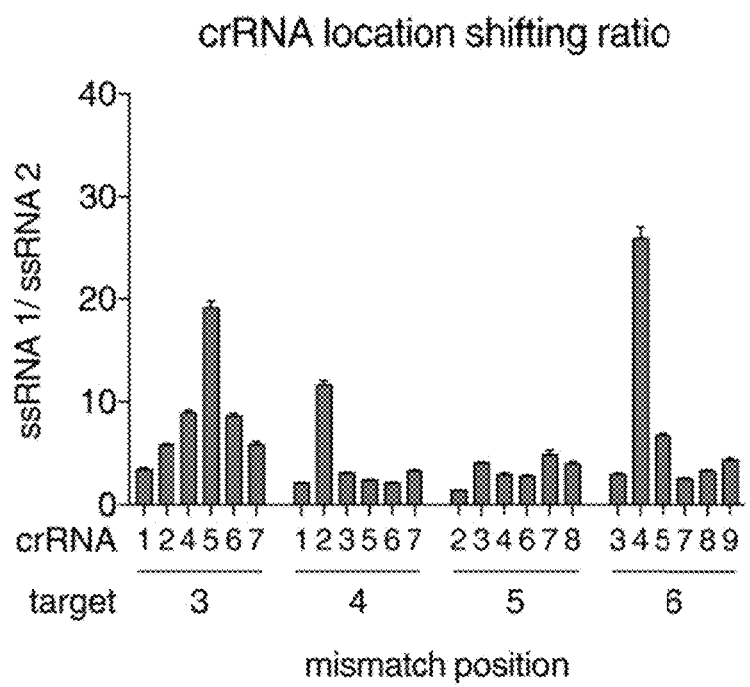
Figure 59:
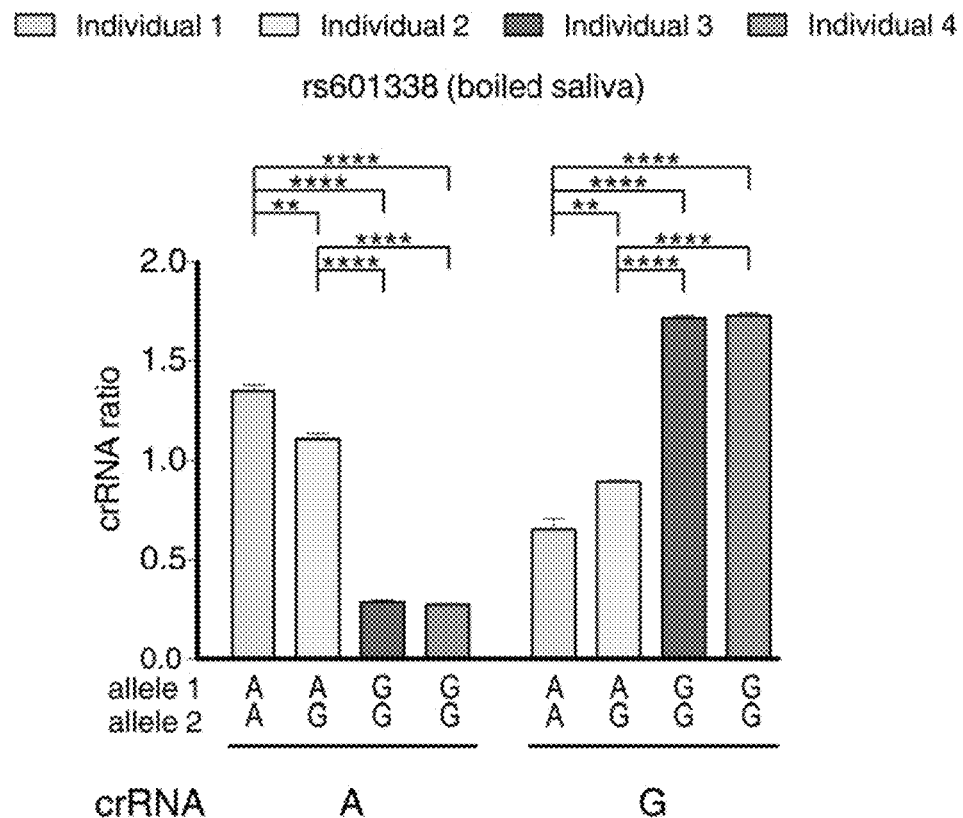
FIG. 59—Genotyping with SHERLOCK at an additional locus and direct genotyping from boiled saliva. SHERLOCK can distinguish between genotypes at the rs601338 SNP site in genomic DNA directly from centrifuged, denatured, and boiled saliva (n=4 technical replicates, two-tailed Student t-test; , p<0.01; **, p<0.001; bars represent mean±s.e.m.).

For mismatch detection of ZIKV and DENV strains, our full-length crRNA contained two mismatches (FIGS. 37A, 37B). Due to high sequence divergence between strains, Applicant was unable to find a continuous stretch of 28 nt with only a single nucleotide difference between the two genomes. However, Applicant predicted that shorter crRNAs would still be functional, and designed shorter 23 nt crRNAs against targets in the two ZIKV strains that included a synthetic mismatch in the spacer sequence and only one mismatch in the target sequence. These crRNAs could still distinguish African and American strains of ZIKV (FIG. 36C). Subsequent testing of 23 nt and 20 nt crRNA show that reductions of spacer length reduce activity but maintain or enhance the ability to discriminate single mismatches (FIGS. 57A-57G). To better understand how synthetic mismatches may be introduced to facilitate single-nucleotide mutation discrimination, Applicant tiled the synthetic mismatch across the first seven positions of the spacer at three different spacer lengths: 28, 23, and 20 nt (FIG. . 57A). On a target with a mutation at the third position, LwCas13a shows maximal specificity when the synthetic mismatch is in position 5 of the spacer, with improved specificity at shorter spacer lengths, albeit with lower levels of on-target activity (FIG. 57B-G). Applicant also shifted the target mutation across positions 3-6 and tiled synthetic mismatches in the spacer around the mutation (FIGS. 58A-58C).

Genotyping with SHERLOCK Using Synthetic Standards.

Figure 60A:
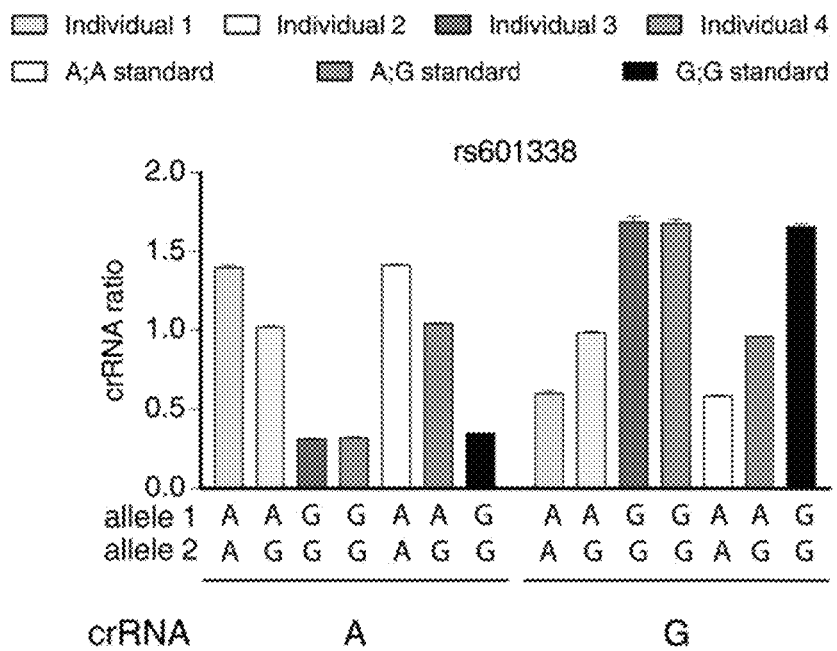
FIGS. 60A-60E illustrate development of synthetic genotyping standards to accurately genotype human SNPs.
Figure 60B:
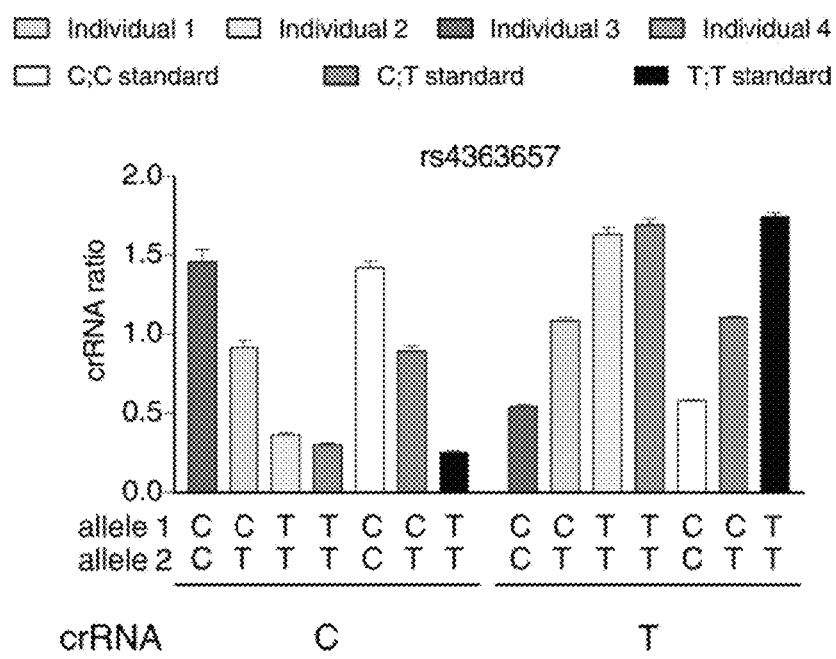
Figure 60C:
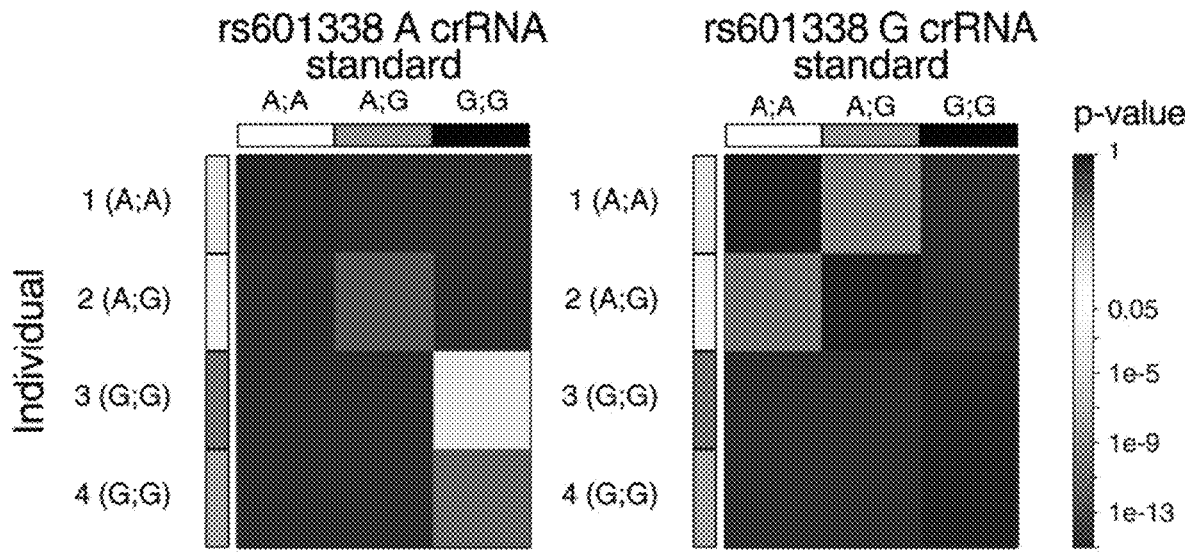
Figure 60D:
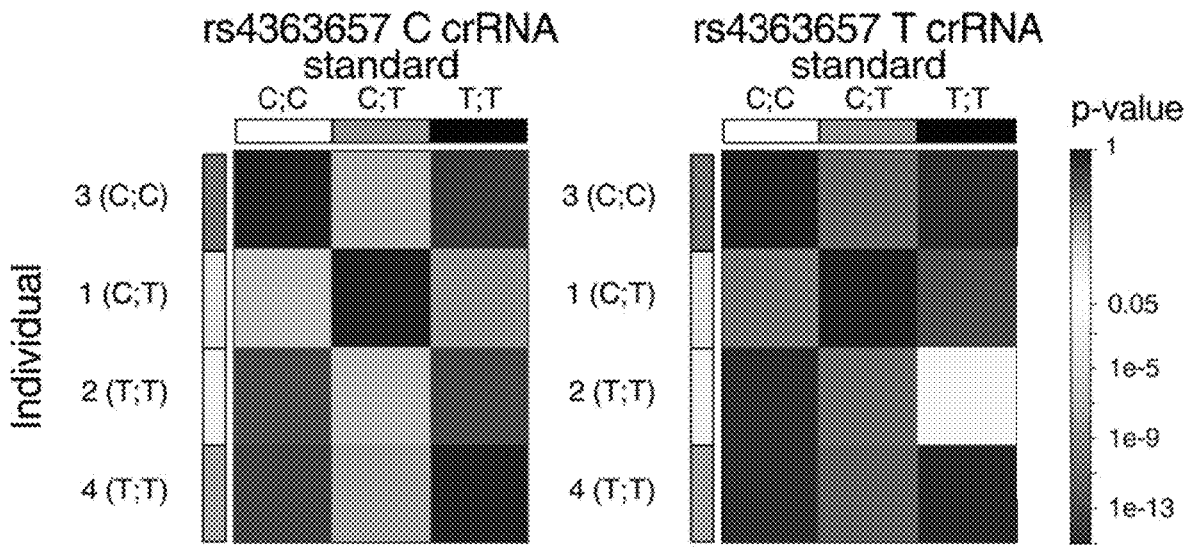
Figure 60E:
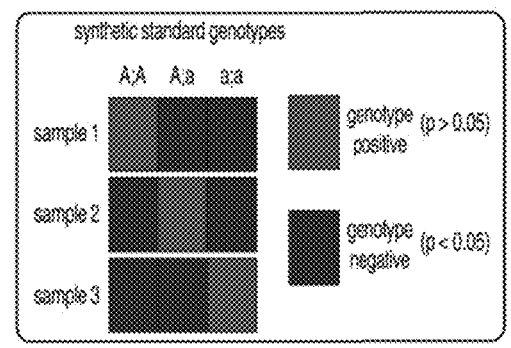

Evaluation of synthetic standards created from PCR amplification of the SNP loci allows for accurate identification of genotypes (FIGS. 60A, 60B). By computing all comparisons (ANOVA) between the SHERLOCK results of an individual's sample and the synthetic standards, each individual's genotype can be identified by finding the synthetic standard that has the most similar SHERLOCK detection intensity (FIGS. 60C, 60D). This SHERLOCK genotyping approach is generalizable to any SNP locus (FIG. 60E).

SHERLOCK is an Affordable, Adaptable CRISPR-Dx Platform.

For the cost analysis of SHERLOCK, reagents determined to be of negligible cost were omitted, including DNA templates for the synthesis of crRNA, primers used in RPA, common buffers (MgCl2, Tris HCl, glycerol, NaCl, DTT), glass microfiber filter paper, and RNAsecure reagent. For DNA templates, ultramer synthesis from IDT provides material for 40 in vitro transcription reactions (each being enough for ~10,000 reactions) for ~$70, adding negligible cost to crRNA synthesis. For RPA primers, a 25 nmole IDT synthesis of a 30 nt DNA primer can be purchased for ~$10, providing material adequate for 5000 SHERLOCK reactions. Glass microfiber paper is available for $0.50/sheet, which is sufficient for several hundred SHERLOCK reactions. 4% RNAsecure reagent costs $7.20/mL, which is sufficient for 500 tests.

In addition, for all experiments, except the paper-based assays, 384-well plates were used (Corning 3544), at the cost of $0.036/reaction. Because of the negligible cost, this was not included in the overall cost analysis. Additionally, SHERLOCK-POC does not require the use of a plastic vessel, as it can easily be performed on paper. The readout method for SHERLOCK used herein was a plate reader equipped with either a filter set or a monochromator. As a capital investment, the cost of the reader was not included in the calculation, as the cost precipitously decreases as more reactions are run on the instrument and is negligible. For POC applications, cheaper and portable alternatives could be used, such as hand-held spectrophotometers (9) or portable electronic readers (4), which reduce the cost of instrumentation to <$200. While these more portable solutions will reduce the speed and ease of readout as compared to bulkier instruments, they allow for more broad use.

Results

The assay and systems described herein may generally comprise a two-step process of amplification and detection. During the first step, the nucleic acid sample, either RNA or DNA, is amplified, for example by isothermal amplification. During the second step, the amplified DNA is transcribed into RNA and subsequently incubated with a CRISPR effector, such as C2c2, and a crRNA programmed to detect the presence of the target nucleic acid sequence. To enable detection, a reporter RNA that has been labeled with a quenched fluorophore is added to the reaction. Collateral cleavage of the reporter RNA results in un-quenching of the fluorophore and allows for real-time detection of the nucleic acid target (FIG. 17).

To achieve robust signal detection, an ortholog of C2c2 was identified from the organism *Leptotrichia wadei* (LwC2c2) and evaluated. The activity of the LwC2c2 protein was evaluated by expressing it along with a synthetic CRISPR array in *E. coli* and programming it to cleave a target site within the beta-lactamase mRNA, which leads to death of the bacteria under ampicillin selection (FIG. 2B). Fewer surviving *E. coli* colonies were observed with the LwC2c2 locus than with the LshC2c2 locus, demonstrating a higher cleavage activity of the LwC2c2 ortholog (FIG. 2C). The human-codon optimized LwC2c2 protein was then purified from *E. coli* (FIGS. 2D-2E) and its ability to cleave a 173-nt ssRNA assayed with different protospacer flanking site (PFS) nucleotides (FIG. 2F). LwC2c2 was able to cleave each of the possible four PFS targets, with slightly less activity on the ssRNA with a G PFS.

Figure 18:
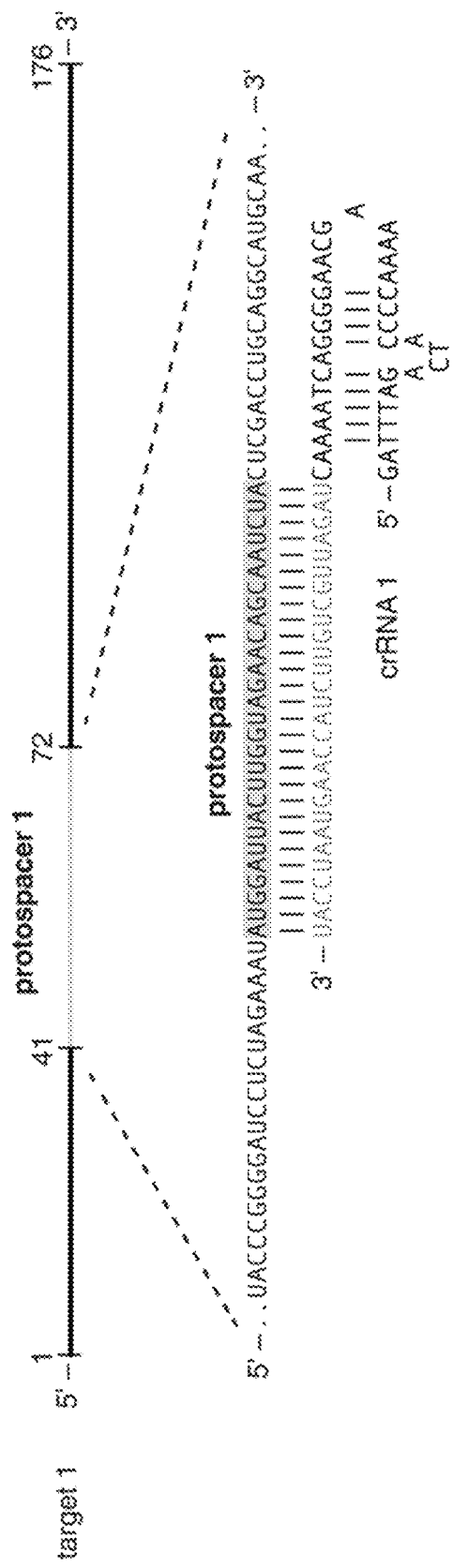
FIG. 18—provides a schematic of ssRNA target detected via the C2c2 collateral detection (SEQ. I.D. Nos. 144 and 145).
Figure 19:
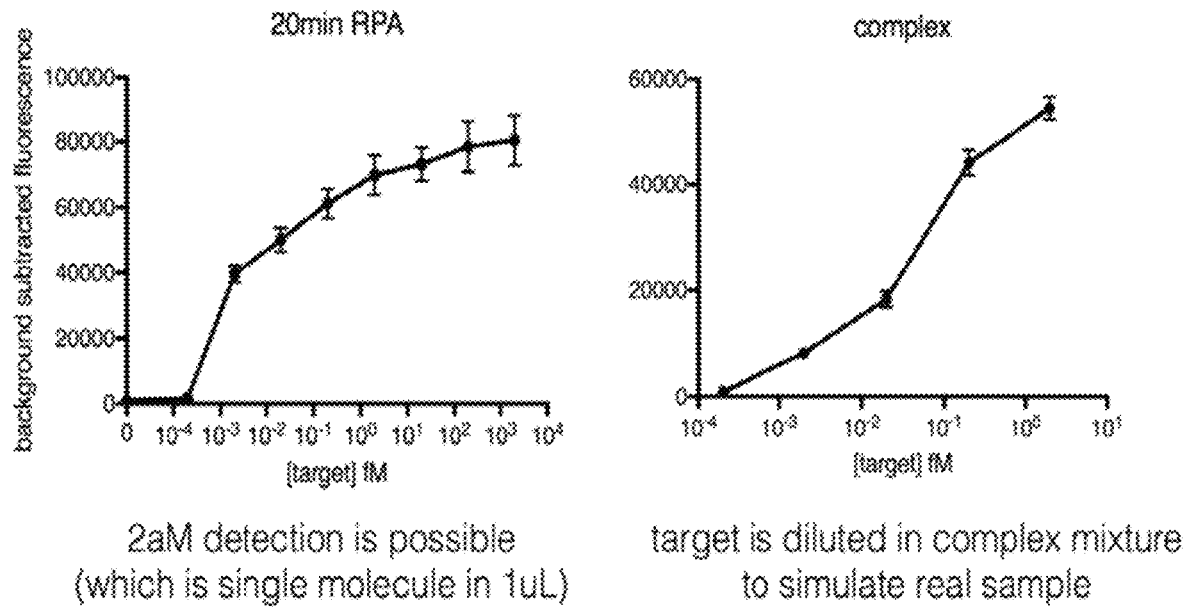
FIG. 19—provides a set of graphs demonstrating single molecule DNA detection using RPA (i.e. within 15 minutes of C2c2 addition).
Figure 20:
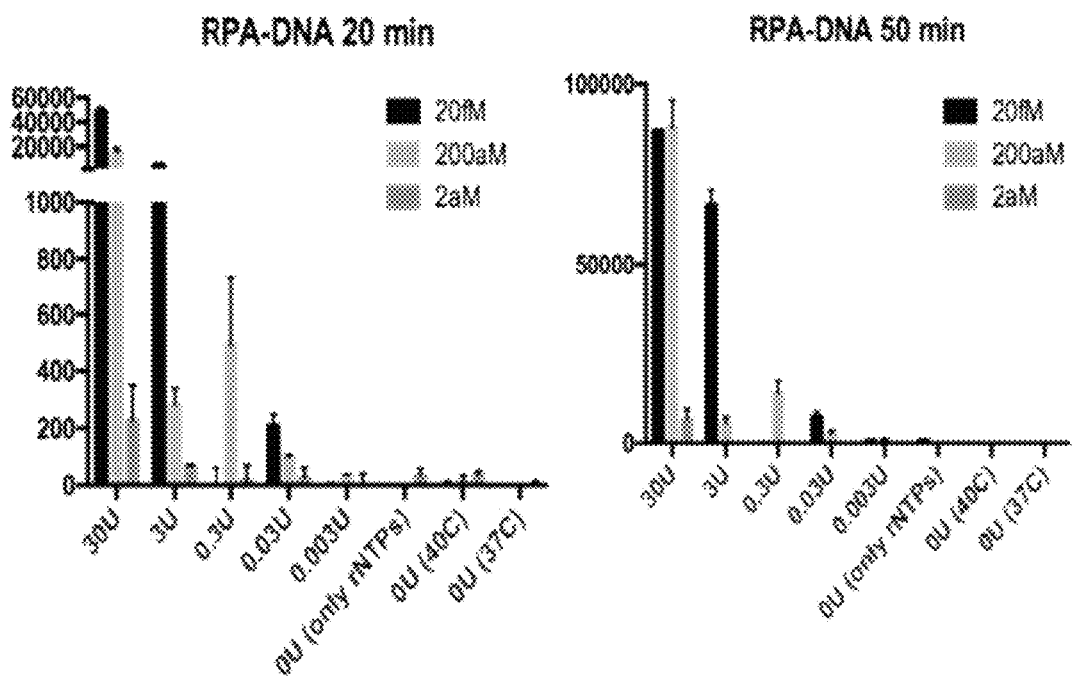
FIG. 20—provides a set of graphs demonstrating that mixing T7 polymerase into a RPA reaction does adversely affect DNA detection.
Figure 21:
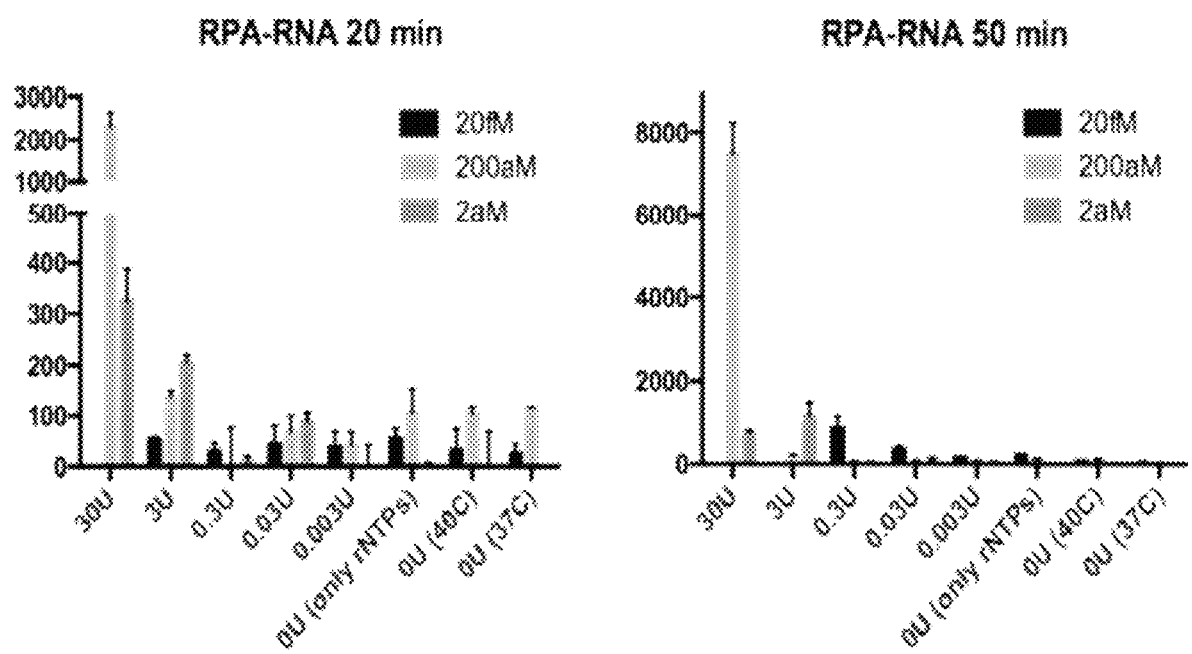
FIG. 21—provides a set of graphs demonstrating that mixing polymerase into an RPA reaction does not adversely affect DNA detection.

Real-time measurement of LwC2c2 RNase collateral activity was measured using a commercially available RNA fluorescent plate reader (FIG. 17). To determine the baseline sensitivity of LwC2c2 activity, LwC2c2 was incubated with ssRNA target 1 (ssRNA 1) and a crRNA that is complementary to a site within the ssRNA target, along with the RNA sensor probe (FIG. 18). This yielded a sensitivity of ~50 fM (FIG. 27A), which, although more sensitive than other recent nucleic acid detection technologies(Pardee et al., 2014), is not sensitive enough for many diagnostic applications which require sub-femtomolar detection performance (Barletta et al., 2004; Emmadi et al., 2011; Rissin et al., 2010; Song et al., 2013).

To increase sensitivity, an isothermal amplification step was added prior to incubation with LwC2c2. Coupling LwC2c2-mediated detection with previously used isothermal amplification approaches such as nucleic acid sequence based amplification (NASBA)(Compton, 1991; Pardee et al., 2016) improved sensitivity to a certain extent (FIG. 11). An alternative isothermal amplification approach, recombinase polymerase amplification (RPA) (Piepenburg et al., 2006), was tested which can be used to amplify DNA exponentially in under two hours. By adding a T7 RNA polymerase promoter onto the RPA primers, amplified DNA can be converted to RNA for subsequent detection by LwC2c2 (FIG. 17). Thus, in certain example embodiments, the assay comprises the combination of amplification by RPA, T7 RNA polymerase conversion of DNA to RNA, and subsequent detection of the RNA by C2c2 unlocking of fluorescence from a quenched reporter.

Figure 22:
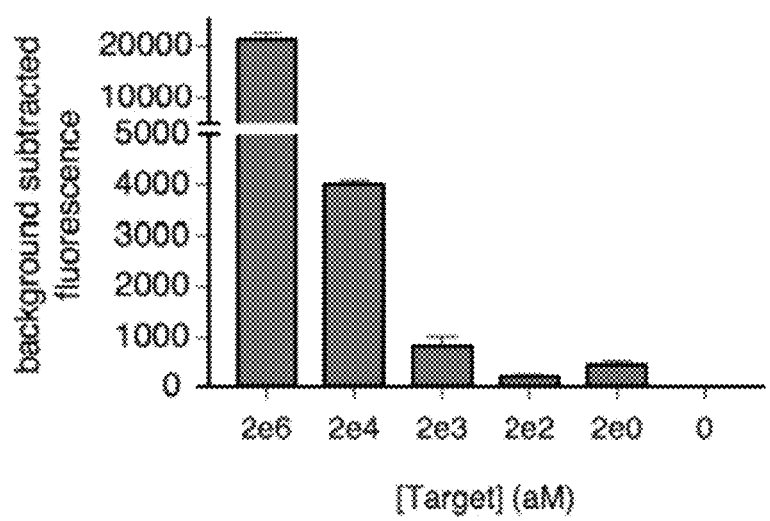
FIG. 22—provides a graph demonstrating that RPA, T7 transcription, and C2c2 detection reactions are compatible and achieve single molecule detection when incubated simultaneously (n=2 technical replicates; bars represent mean±s.e.m.).
Figure 23:
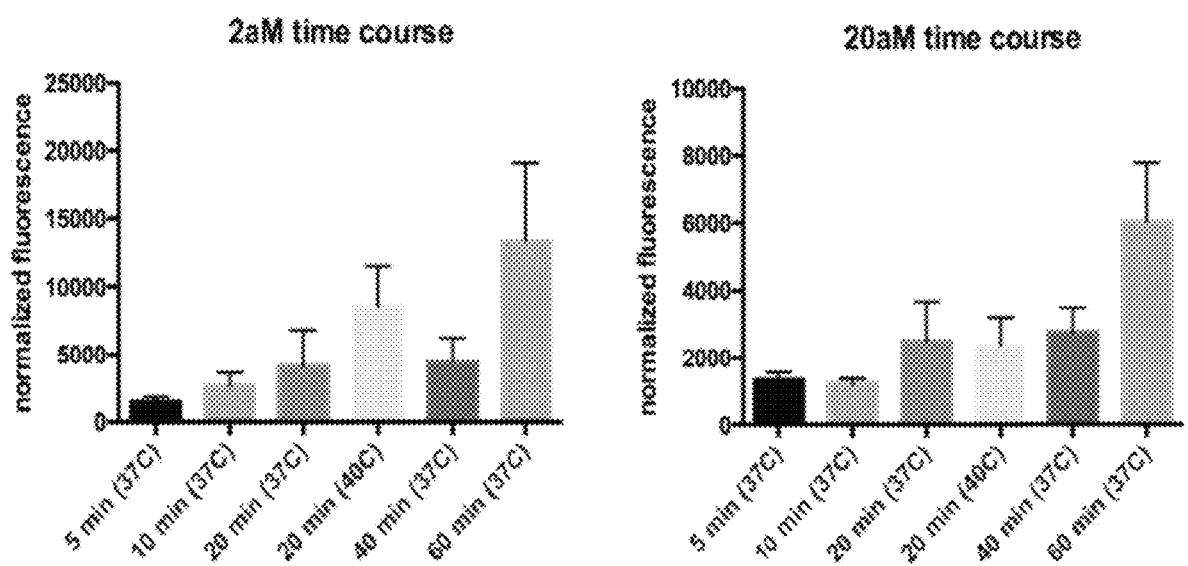
FIG. 23—provides a set of graphs demonstrating the efficacy of quick RPA-RNA time incubations.
Figure 24:
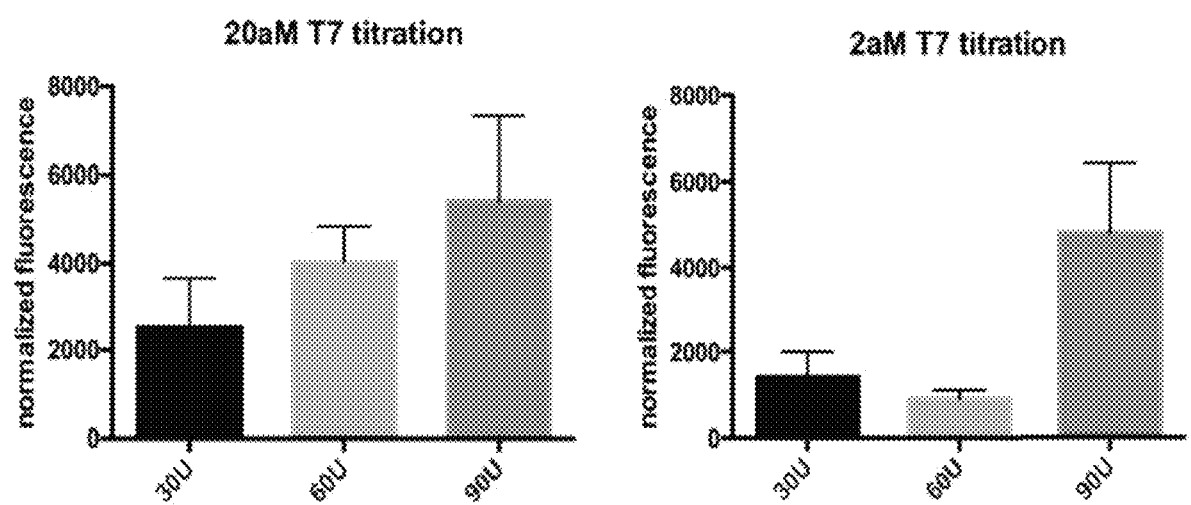
FIG. 24—provides a set of graphs demonstrating that increasing T7 polymerase amount boosts sensitivity for RPA-RNA.
Figure 25:
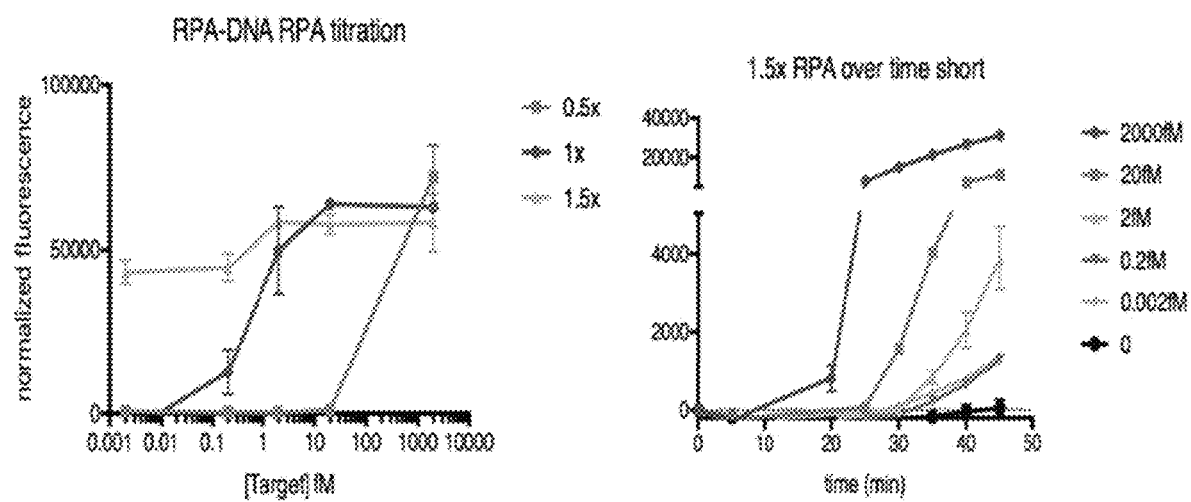
FIG. 25—provides a set of graphs showing results from an RPA-DNA detection assay using a one-pot reaction with 1.5× enzymes. Single molecule (2 aM) detection achieved as early as 30 minutes.
Figure 26:
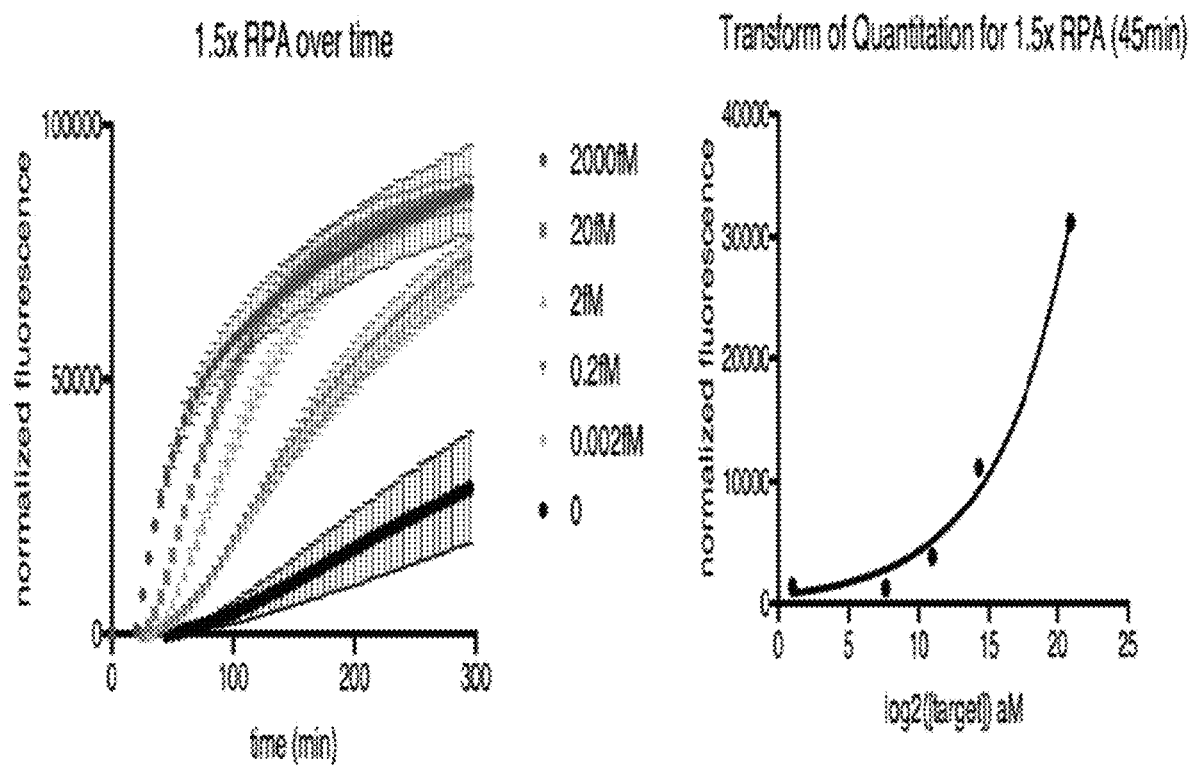
FIG. 26—provides a set of graphs demonstrating that an RPA-DNA one-pot reaction demonstrates a quantitative decrease in fluorescence relative to input concentration. The fitted curve reveals relationship between target input concentration and output fluorescence.
Figure 28:
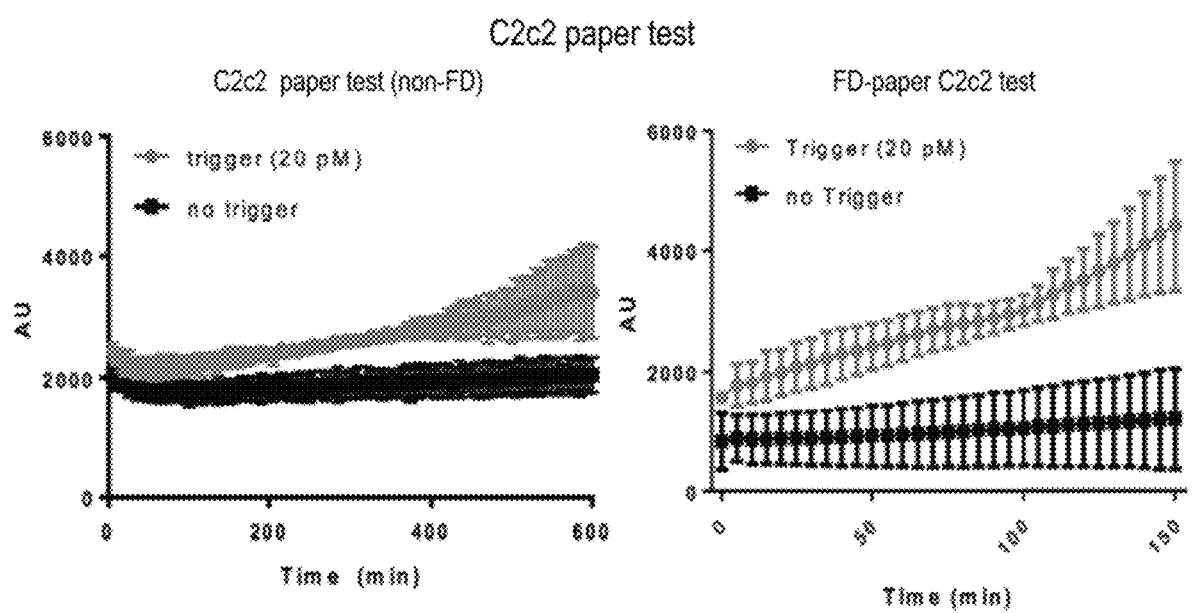
FIG. 28—provides a set of graphs demonstrating that a C2c2 signal generated in accordance with certain example embodiments can detect a 20 pM target on a paper substrate.
Figure 29:
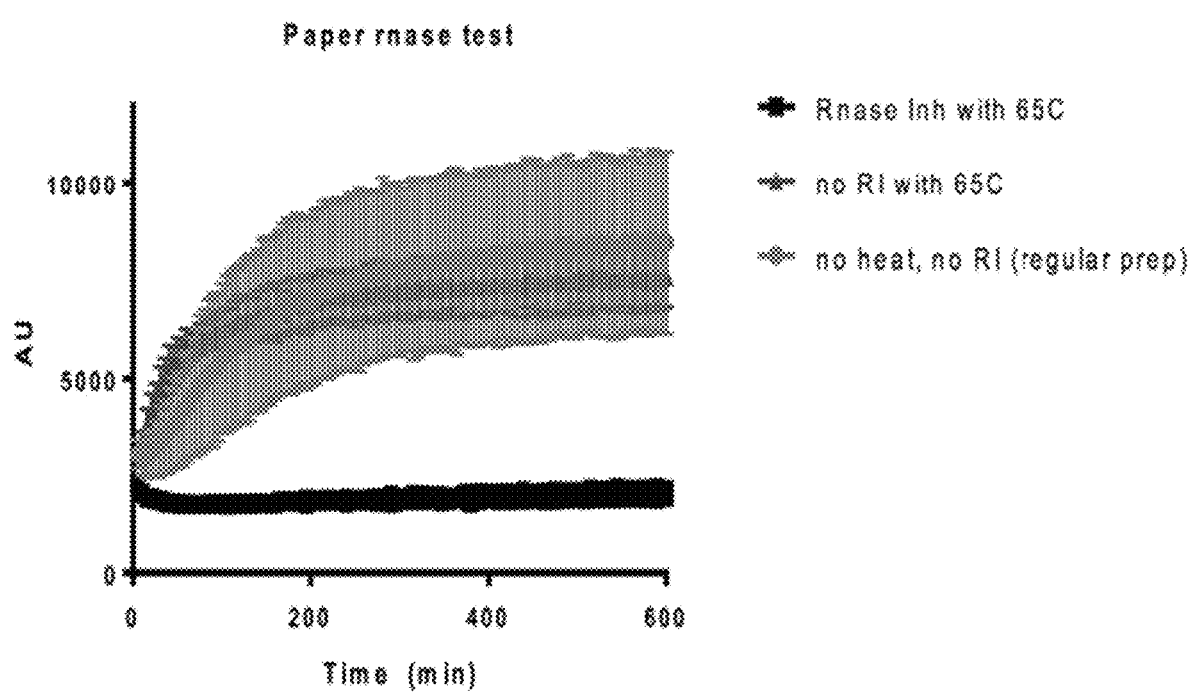
FIG. 29—provides a graph showing that a specific RNAse inhibitor is capable of removing background signal on paper.
Figure 30:
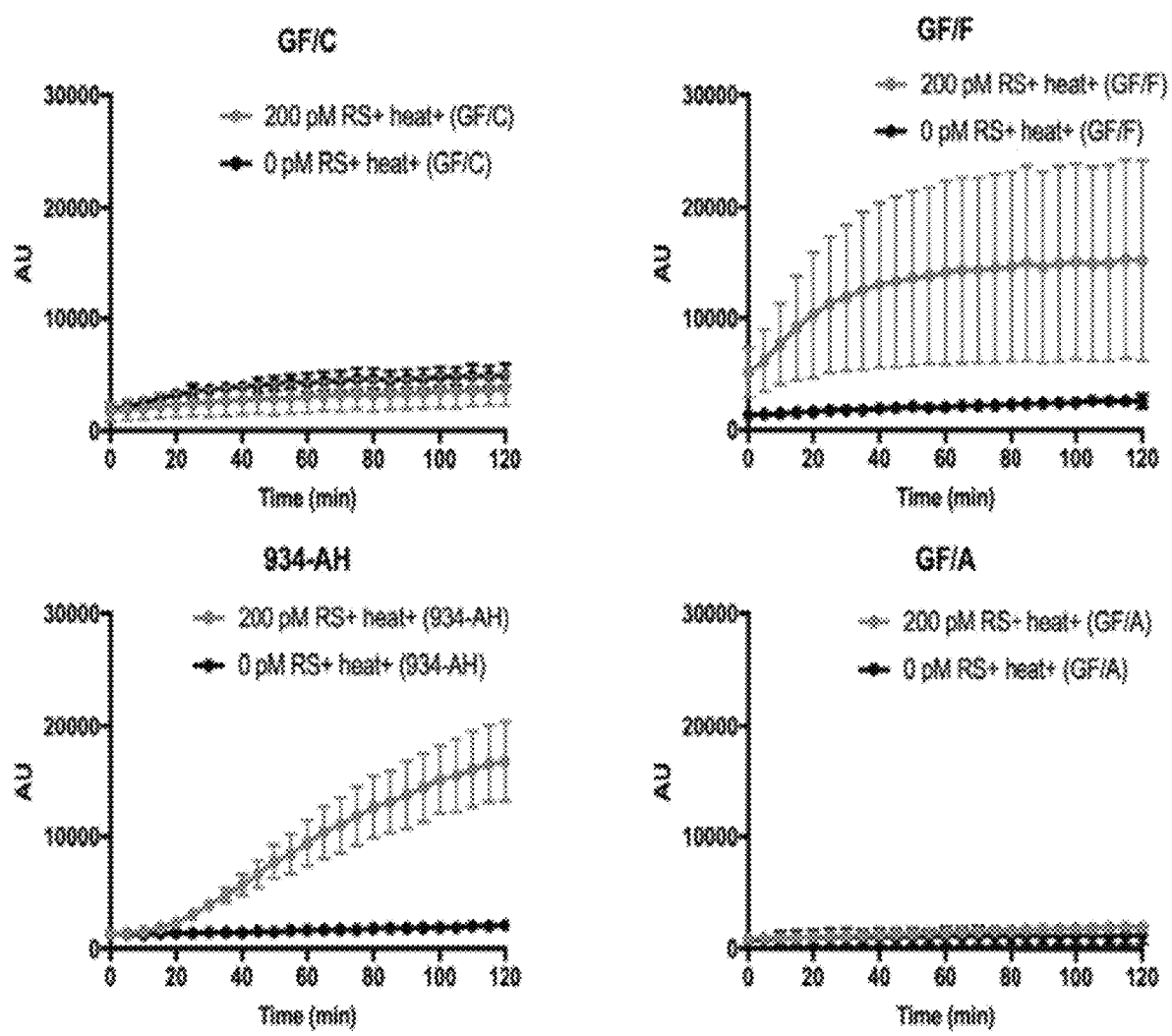
FIG. 30 is a set of graphs showing detection using systems in accordance with certain example embodiments on glass fiber substrates.

Using the example method on a synthesized DNA version of ssRNA 1, it was possible to achieve attomolar sensitivity in the range of 1-10 molecules per reaction (FIG. 27B, left). In order to verify the accuracy of detection, the concentration of input DNA was qualified with digital-droplet PCR and confirmed that the lowest detectable target concentration (2 aM) was at a concentration of a single molecule per microliter. With the addition of a reverse transcription step, RPA can also amplify RNA into a dsDNA form, allowing us attomolar sensitivity on ssRNA 1 to be achieved (27B, right). Similarly, the concentrations of RNA targets were confirmed by digital-droplet PCR. To evaluate the viability of the example method to function as a POC diagnostic test, the ability of all components—RPA, T7 polymerase amplification, and LwC2c2 detection—to function in a single reaction were tested and found attomolar sensitivity with a one-pot version of the assay (FIG. 22).

The Assay is Capable of Sensitive Viral Detection in Liquid or on Paper

Figure 31A:
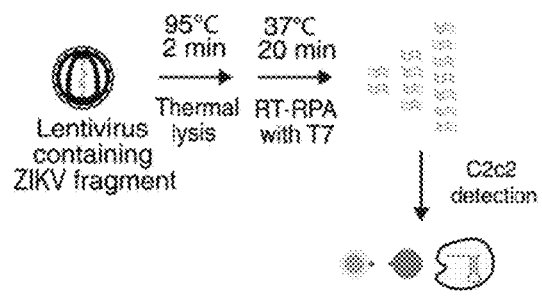
FIGS. 31A-31D—provides a set of graphs providing (FIG. 31A) a schematic of Zika RNA detection in accordance with certain example embodiments. Lentivirus was packaged with Zika RNA or homologous Dengue RNA fragments targeted by C2c2 collateral detection. Media is harvested after 48 hours and subjected to thermal lysis, RT-RPA, and C2c2 detection.
Figure 31B:
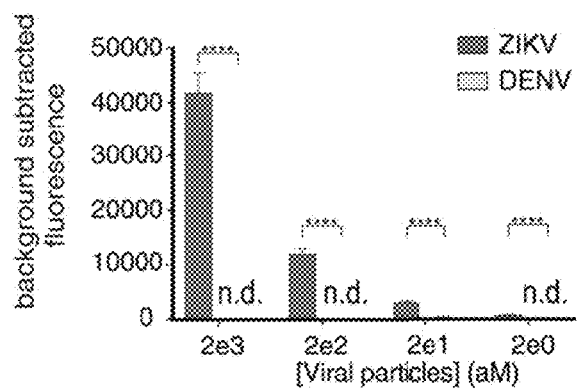
Figure 31C:
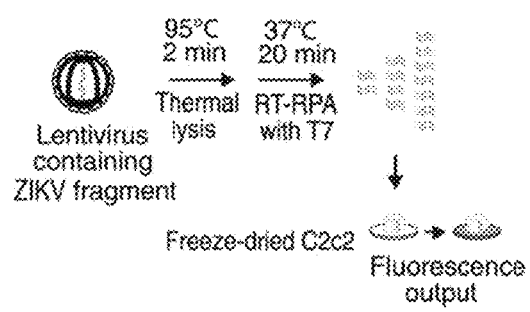
Figure 33A:
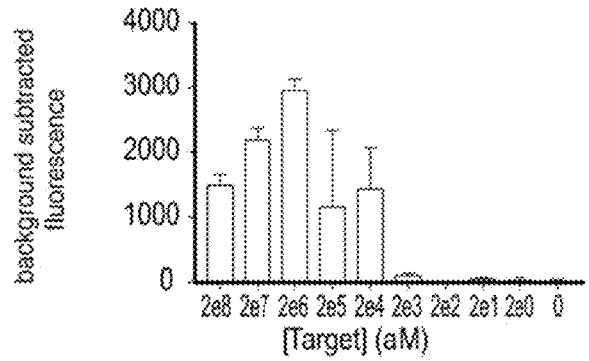
FIGS. 33A-33G—provides a set of graphs demonstrating (FIG. 33A) freeze-dried C2c2 is capable of sensitive detection of ssRNA 1 in the low femtomolar range. C2c2 is capable of rapid detection of a 200 pM ssRNA 1 target on paper in liquid form (FIG. 33B) or freeze dried (FIG. 33C). The reaction is capable of sensitive detection of synthesized Zika RNA fragments in solution (FIG. 33D) (n=3) and in freeze-dried form (FIG. 33E) (n=3).
Figure 33B:
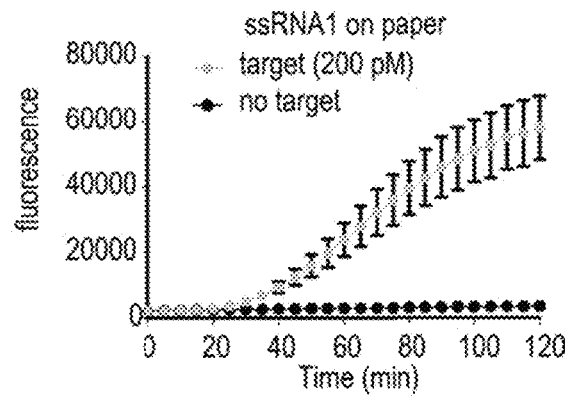
Figure 33C:
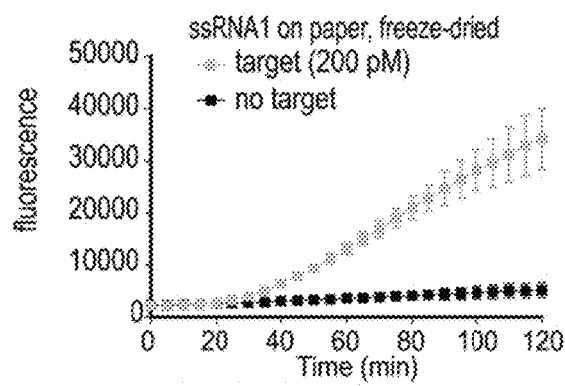
Figure 33D:
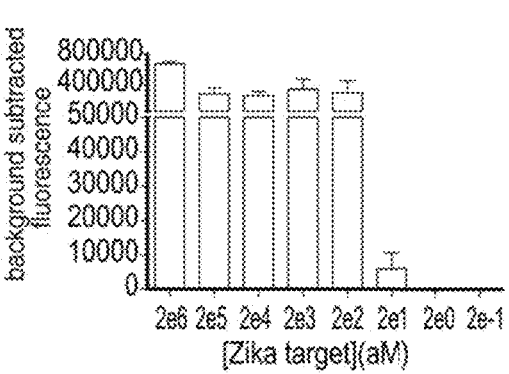
Figure 33E:
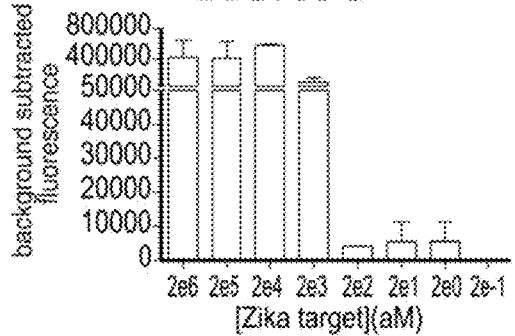

It was next determined whether the assay would be effective in infectious disease applications that require high sensitivity and could benefit from a portable diagnostic. To test detection in a model system, lentiviruses harboring RNA fragments of the Zika virus genome and the related flavivirus Dengue (Dejnirattisai et al., 2016) were produced and the number of viral particles quantified (FIG. 31A). Levels of mock virus were detected down to 2 aM. At the same time, it was also possible to show clear discrimination between these proxy viruses containing Zika and Dengue RNA fragments (FIG. 31B). To determine whether the assay would be compatible with freeze-drying to remove dependence on cold chains for distribution, the reaction components were freeze-dried. After using the sample to rehydrate the lyophilized components, 20 fM of ssRNA 1 was detected (FIG. 33A). Because resource-poor and POC settings would benefit from a paper test for ease of usability, the activity of C2c2 detection on glass fiber paper was also evaluated and found that a paper-spotted C2c2 reaction was capable of target detection (FIG. 33B). In combination, freeze-drying and paper-spotting the C2c2 detection reaction resulted in sensitive detection of ssRNA 1 (FIG. 33C). Similar levels of sensitivity were also observed for detection of a synthetic Zika viral RNA fragment between LwC2c2 in solution and freeze-dried LwC2c2, demonstrating the robustness of freeze-dried SHERLOCK and the potential for a rapid, POC Zika virus diagnostic (FIGS. 33D, 33E). Toward this end, the ability of the POC variant of the assay was tested to determine the ability to discriminate Zika RNA from Dengue RNA (FIG. 31C). While paper-spotting and lyophilization slightly reduced the absolute signal of the readout, the assay still significantly detected mock Zika virus at concentrations as low as 20 aM (FIG. 31D), compared to detection of mock virus with the Dengue control sequence.

Figure 31D:
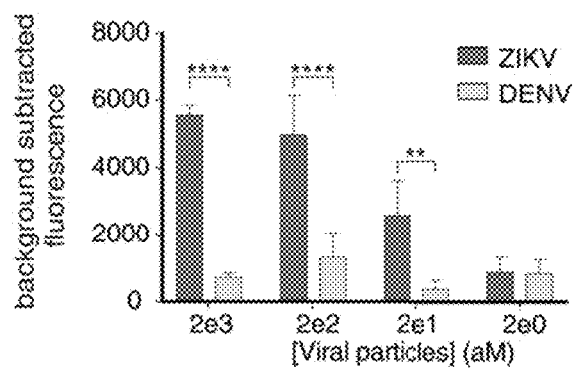
Figure 32A:
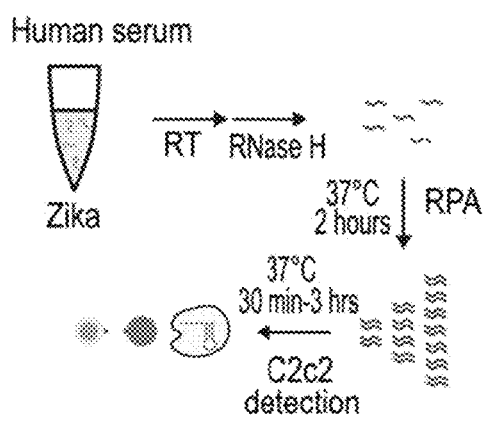
FIG. 32A is a schematic for C2c2 detection of Zika RNA isolated from human serum. Zika RNA in serum is subjected to reverse transcription, RNase H degradation of the RNA, RPA of the cDNA, and C2c2 detection.
Figure 32B:
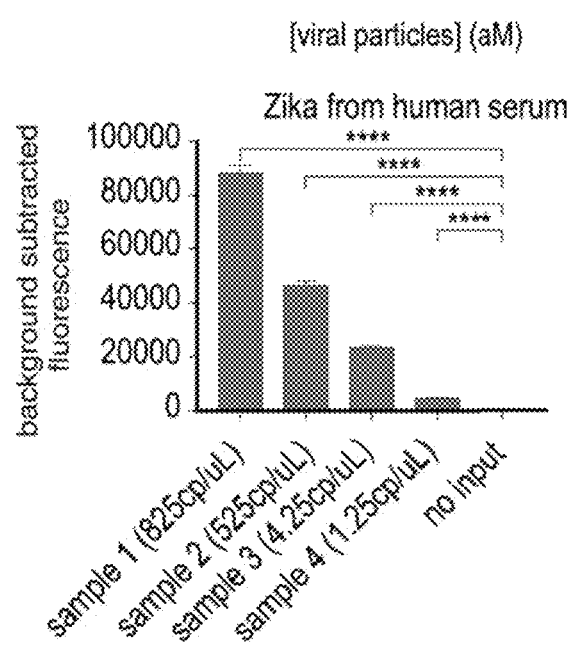
FIG. 32B is a graph showing that C2c2 is capable of highly sensitive detection of human Zika serum samples. Concentrations of Zika RNA shown were verified by qPCR (n=4 technical replicates, two-tailed Student t-test; ****, p<0.0001; bars represent mean±s.e.m.).
Figure 33F:
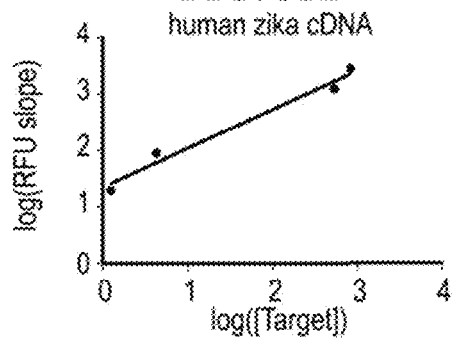
Figure 33G:
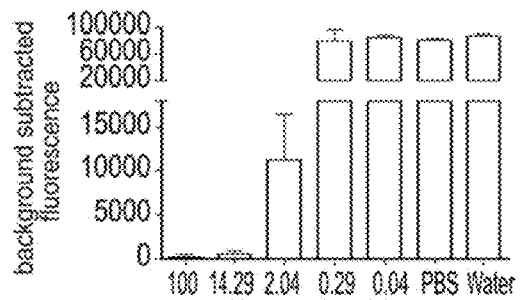

Zika viral RNA levels in humans have been reported to be as low as $3 \times 10^6$ copies/mL (4.9 fM) in patient saliva and $7.2 \times 10^5$ copies/mL (1.2 fM) in patient serum (Barzon et al., 2016; Gourinat et al., 2015; Lanciotti et al., 2008). From obtained patient samples, concentrations as low as $1.25 \times 10^3$ copies/mL (2.1 aM) were observed. To evaluate whether the assay is capable of Zika virus detection of low-titer clinical isolates, viral RNA was extracted from patients and reverse transcribed and the resulting cDNA was used as input for the assay (FIG. 32A). Significant detection for the Zika human serum samples was observed at concentrations down to 1.25 copy/µL (2.1 aM) (FIG. 32B). Furthermore, signal from patient samples was predictive of Zika viral RNA copy number and could be used to predict viral load (FIGS. 31B, 31D). To test broad applicability for disease situations where nucleic acid purification is unavailable, detection of ssRNA 1 spiked into human serum was tested, and it was determined that the assay was activated at serum levels below 2% (FIG. 33G).

Bacterial Pathogen Distinction and Gene Distinction

To determine if the assay could be used to distinguish bacterial pathogens, the 16S V3 region was selected as an initial target, as the conserved flanking regions allow universal RPA primers to be used across bacterial species, and the variable internal region allowing for differentiation of species. A panel of 5 possible targeting crRNAs were designed for pathogenic strains and isolated *E. coli* and *Pseudomonas aeruginosa* gDNA (FIG. 34A). The assay was capable of distinguishing *E. coli* or *P. aeruginosa* gDNA and showed low background signal for crRNAs of other species (FIGS. 34A-34C).

The assay can also be adapted to rapidly detect and distinguish bacterial genes of interest, such as antibiotic-resistance genes. Carbapenem-resistant enterobacteria (CRE) are a significant emerging public health challenge (Gupta et al., 2011). The ability of the assay to detect carbapenem-resistance genes was evaluated, and if the test could distinguish between different carbapenem-resistance genes. *Klebsiella pneumonia* was obtained from clinical isolates harboring either *Klebsiella pneumoniae* carbapenemase (KPC) or New Delhi metallo-beta-lactamase 1 (NDM-1) resistance genes and designed crRNAs to distinguish between the genes. All CRE had significant signal over bacteria lacking these resistance genes (FIG. 35A) and that we could significantly distinguish between KPC and NDM-1 strains of resistance (FIG. 35B).

Single-Base Mismatch Specificity of CRISPR RNA-Guided RNases

It has been shown that certain CRISPR RNA-guided RNase orthologues, such as LshC2c2, do not readily distinguish single-base mismatches. (Abudayyeh et al., 2016). As demonstrated herein, LwC2c2 also shares this feature (FIG. 37A). To increase the specificity of LwC2c2 cleavage, a system for introducing synthetic mismatches in the crRNA: target duplex was developed that increases the total sensitivity to mismatches and enables single-base mismatch sensitivity. Multiple crRNAs for target 1 were designed and included mismatches across the length of the crRNA (FIG. 37A) to optimize on-target cleavage and minimize cleavage of a target that differs by a single mismatch. These mismatches did not reduce cleavage efficiency of ssRNA target 1, but significantly decreased signal for a target that included an additional mismatch (ssRNA target 2). The designed crRNA that best distinguished between targets 1 and 2 included synthetic mismatches close to the target 2 mismatch, in effect creating a "bubble." The loss of sensitivity caused by the coordination of a synthetic mismatch and an additional mismatch present in the target (i.e., a double mismatch) agrees with the sensitivity of LshC2c2 to consecutive or nearby double mismatches (Abudayyeh et al., 2016) and presents a format for rational design of crRNAs that enable single-nucleotide distinction (FIG. 37B).

Figure 37C:
FIG. 37C shows schematics of Dengue strain 3 and Dengue strain 1 target regions and the crRNA sequences used for detection. SNPs in the target are highlighted red or blue and synthetic mismatches in the guide sequence are colored red.
Figure 37D:
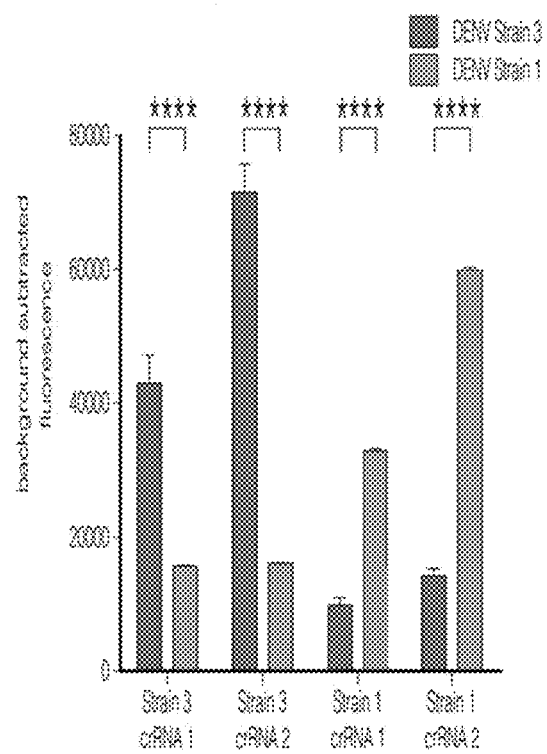
FIG. 37D is a graph showing that highly specific detection of strain SNPs allows for the differentiation of Dengue strain 1 versus strain 3 RNA targets using SHERLOCK (n=2 technical replicates, two-tailed Student t-test; **, p<0.0001; bars represent mean±s.e.m.).

Having demonstrated that C2c2 can be engineered to recognize single-base mismatches, it was determined whether this engineered specificity could be used to distinguish between closely related viral pathogens. Multiple crRNAs were designed to detect either the African or American strains of Zika virus (FIG. 37A) and either strain 1 or 3 of Dengue virus (FIG. 37C). These crRNAs included a synthetic mismatch in the spacer sequence, causing a single bubble to form when duplexed to the on-target strain due to the synthetic mismatch. However, when the synthetic mismatch spacer is duplexed to the off-target strain two bubbles form due to the synthetic mismatch and the SNP mismatch. The synthetic mismatch crRNAs detected their corresponding strains with significantly higher signal than the off-target strain allowing for robust strain distinction (FIGS. 37B, 37D). Due to the significant sequence similarity between strains, it was not possible to find a continuous stretch of 28 nt with only a single nucleotide difference between the two genomes in order to demonstrate true single-nucleotide strain distinction. However, it was predicted that shorter crRNAs would still be functional, as they are with LshC2c2 (Abudayyeh et al., 2016), and accordingly shorter 23-nt crRNAs were designed against targets in the two Zika strains that included a synthetic mismatch in the spacer sequence and only one mismatch in the target sequence. These crRNAs were still capable of distinguishing the African and American strains of Zika with high sensitivity (FIG. 36C).

Rapid Genotyping Using DNA Purified from Saliva

Figure 38A:
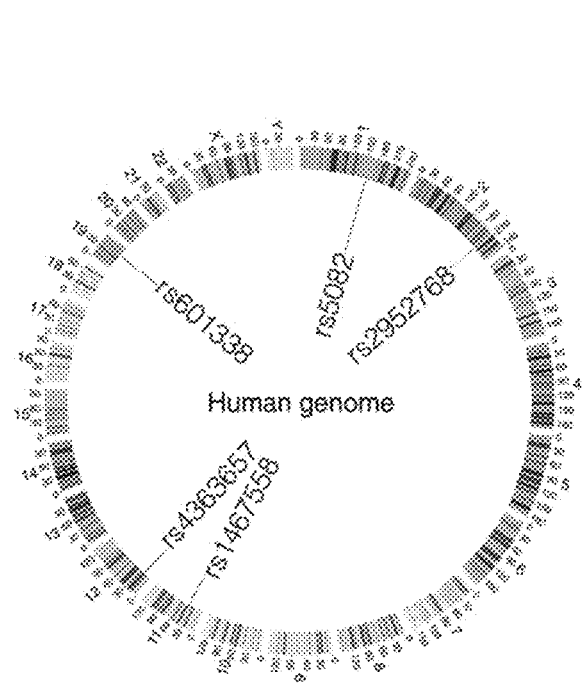
FIG. 38A is a circos plot showing location of human SNPs detected with C2c2. The assay conducted in accordance with certain example embodiments can distinguish between human SNPs.

Rapid genotyping from human saliva could be useful in emergency pharmacogenomic situations or for at-home diagnostics. To demonstrate the potential of the embodiments disclosed herein for genotyping, five loci were chosen to benchmark C2c2 detection using 23andMe genotyping data as the gold standard (Eriksson et al., 2010) (FIG. 38A). The five loci span a broad range of functional associations, including sensitivity to drugs, such as statins or acetaminophen, norovirus susceptibility, and risk of heart disease (Table 14).

TABLE 14

| SNP Variants tested | | |
|---|---|---|
| ID | Gene | Category |
| rs5082 | APOA2 | Saturated fat consumption and weight gain |

TABLE 14-continued

SNP Variants tested

| ID | Gene | Category |
|---|---|---|
| rs1467558 | CD44 | Acetaminophen metabolism |
| rs2952768 | near CREB1 | morphine dependence |
| rs4363657 | SLCO1B1 | 4.5x increase myopathy risk for statin users |
| rs601338 | FUT2 | resistance to norovirus |

Figure 38B:
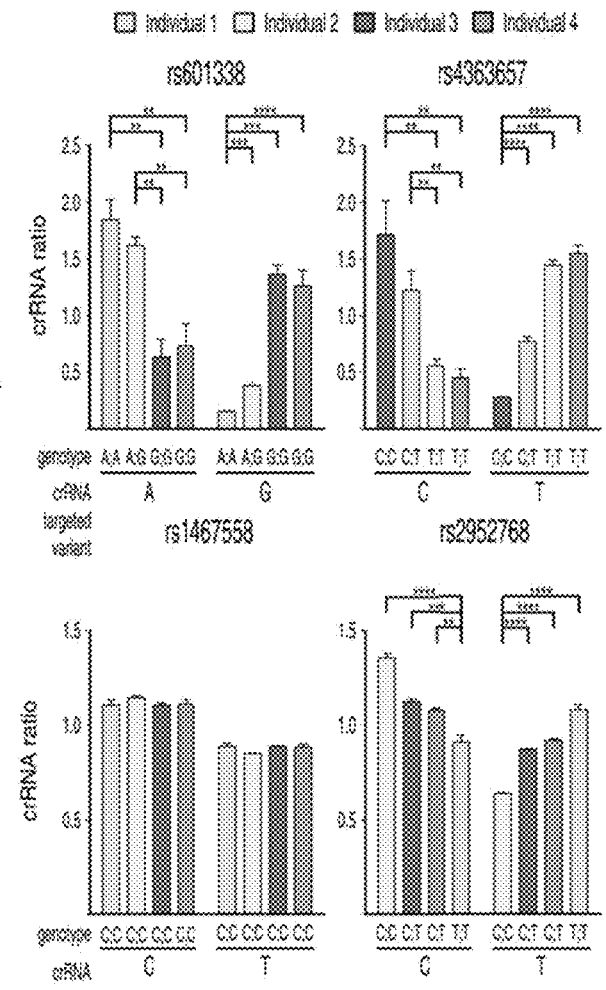
FIG. 38B shows graphs demonstrating that SHERLOCK can correctly genotype four different individuals at four different SNP sites in the human genome. The genotypes for each individual and identities of allele-sensing crRNAs are annotated below each plot (n=4 technical replicates; two-tailed Student t-test; *, p<0.05; , p<0.01; *, p<0.001; ****, p<0.0001; bars represent mean±s.e.m.).
Figure 40A:
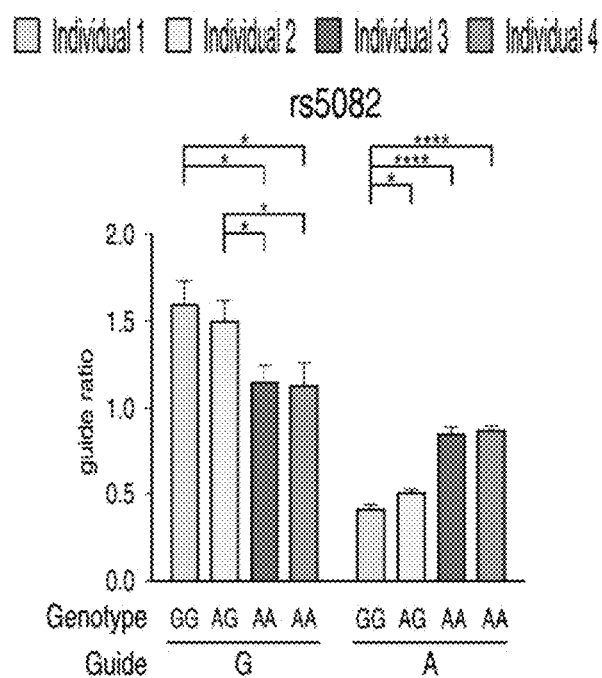
FIG. 40A is a graph demonstrating that the assay can distinguish between genotypes at rs5082 (n=4 technical replicates; *, p<0.05; , p<0.01; *, p<0.001; ****, p<0.0001; bars represent mean±s.e.m.).
Figure 40B:
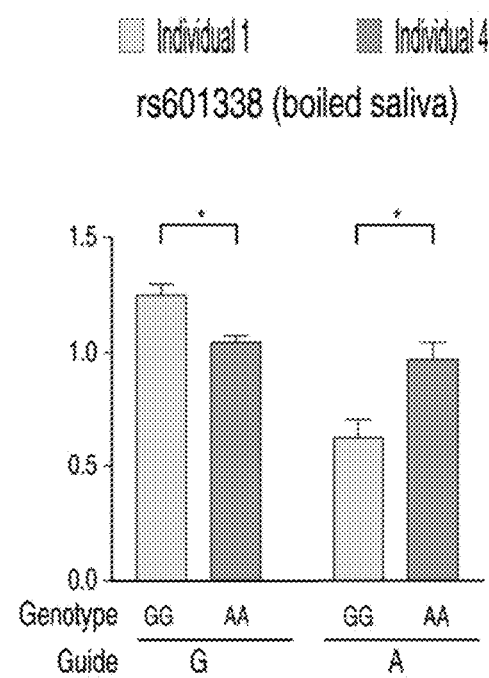
FIG. 40B is a graph demonstrating that the assay can distinguish between genotypes at rs601338 in gDNA directly from centrifuged, denatured, and boiled saliva (n=3 technical replicates; *, p<0.05; bars represent mean±s.e.m.).

Saliva from four human subjects was collected and the genomic DNA purified using a simple commercial kit in less than an hour. The four subjects had a diverse set of genotypes across the five loci, providing a wide enough sample space for which to benchmark the assay for genotyping. For each of the five SNP loci, a subject's genomic DNA was amplified using RPA with the appropriate primers followed by detection with LwC2c2 and pairs of crRNAs designed to specifically detect one of the two possible alleles (FIG. 38B). The assay was specific enough to distinguish alleles with high significance and to infer both homozygous and heterozygous genotypes. Because a DNA extraction protocol was performed on the saliva prior to detection, the assay was tested to determine if it could be made even more amenable for POC genotyping by using saliva heated to 95° C. for 5 minutes without any further extraction. The assay was capable of correctly genotyping two patients whose saliva was only subjected to heating for 5 minutes and then subsequent amplification and C2c2 detection (FIG. 40B).

Detection of Cancerous Mutations in cfDNA at Low-Allelic Fractions

Because the assay is highly specific to single nucleotide differences in targets, a test was devised to determine if the assay was sensitive enough to detect cancer mutations in cell-free DNA (cfDNA). cfDNA fragments are small percentage (0.1% to 5%) of wild-type cfDNA fragments (Bettegowda et al., 2014; Newman et al., 2014; Olmedillas Lopez et al., 2016; Qin et al., 2016). A significant challenge in the cfDNA field is detecting these mutations because they are typically difficult to discover given the high levels of non-mutated DNA found in the background in blood (Bettegowda et al., 2014; Newman et al., 2014; Qin et al., 2016). A POC cfDNA cancer test would also be useful for regular screening of cancer presence, especially for patients at risk for remission.

Figure 41A:
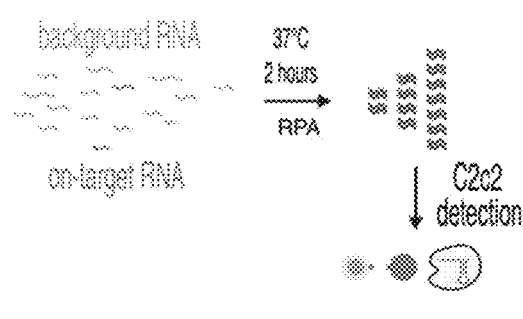
FIG. 41A is a schematic of an example embodiment performed on ssDNA 1 in the background of a target that differs from ssDNA 1 by only a single mismatch.
Figure 41B:
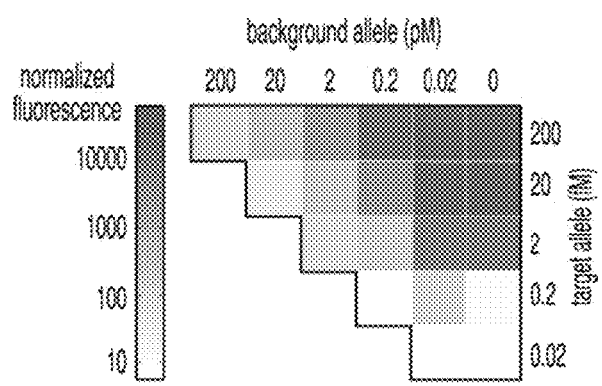
FIG. 41B illustrates that the assay achieves single nucleotide specificity detection of ssDNA 1 in the presence of mismatched background (target that differs by only a single mismatch from ssDNA). Various concentrations of target DNA were combined with a background excess of DNA with one mismatch and detected by the assay.
Figure 42:
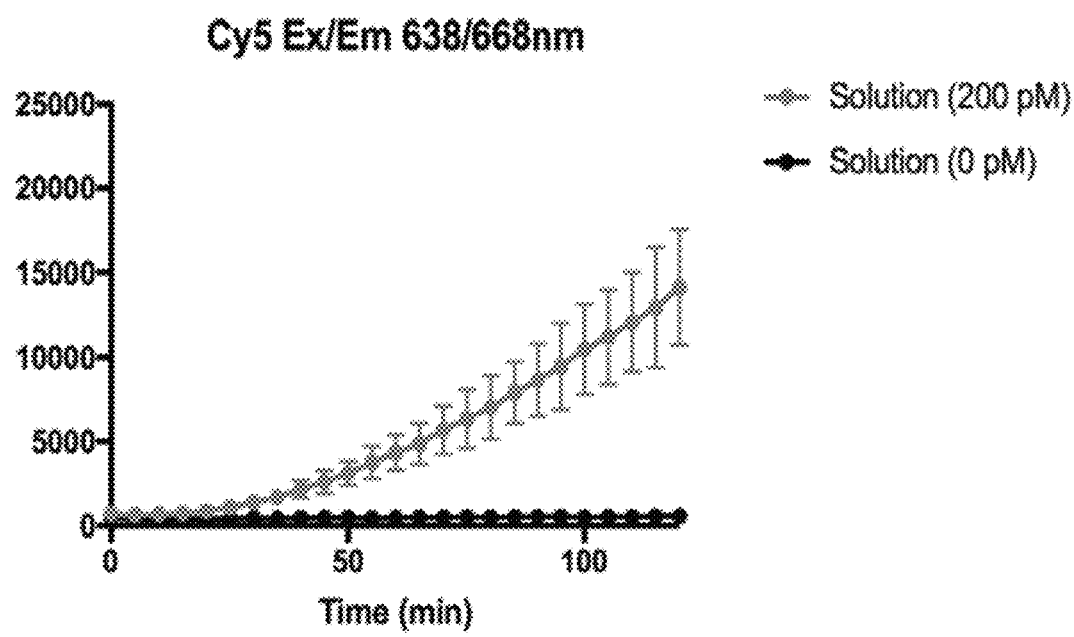
FIG. 42 is a graph showing a masking construct with a different dye Cy5 also allows for effective detection.

The assay's ability to detect mutant DNA in wild-type background was determined by diluting dsDNA target 1 in a background of ssDNA 1 with a single mutation in the crRNA target site (FIGS. 41A, 41B). LwC2c2 was capable of sensing dsDNA 1 to levels as low as 0.1% of the background dsDNA and within attomolar concentrations of dsDNA 1. This result shows that LwC2c2 cleavage of background mutant dsDNA 1 is low enough to allow robust detection of the on-target dsDNA at 0.1% allelic fraction. At levels lower than 0.1%, background activity is likely an issue, preventing any further significant detection of the correct target.

Figure 38C:
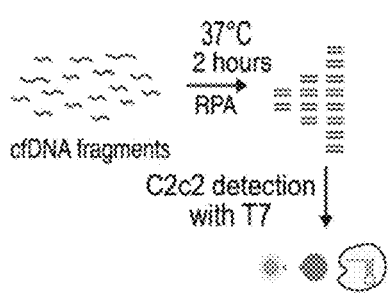
FIG. 38C is a schematic of the process for detection of cfDNA (such as cell free DNA detection of cancer mutations) in accordance with certain example embodiments.
Figure 38D:
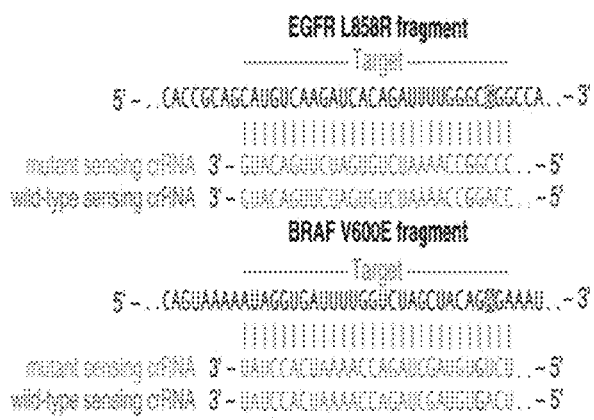
FIG. 38D shows example crRNA sequences for detecting EGFR L858R and BRAF V600E. (SEQ. I.D. Nos. 177 through 182). Sequences of two genomic loci assayed for cancer mutations in cell-free DNA. Shown are the target genomic sequence with the SNP highlighted in blue and the mutant/wildtype sensing crRNA sequences with synthetic mismatches colored in red.
Figure 39A:
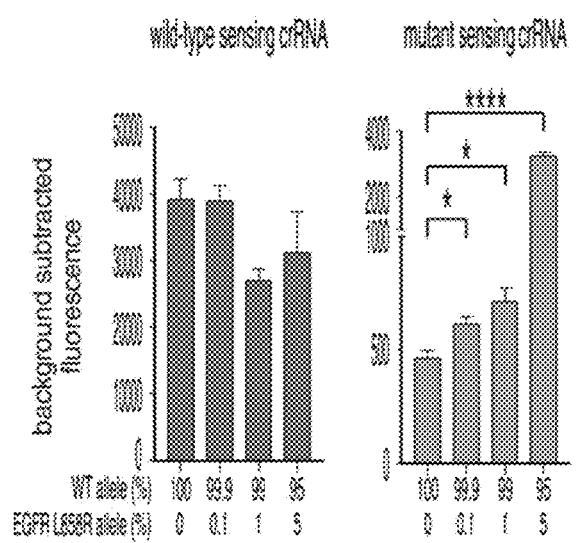
FIGS. 39A and 39B show graphs demonstrating that C2c2 can detect the mutant minor allele in mock cell-free DNA samples from the EGFR L858R (FIG. 39A) or from the BRAF V600E (FIG. 39B) minor allele. (n=4 technical replicates, two tailed Student t-test; *, p<0.05; , p<0.01, **, P<0.0001; bars represent±s.e.m.)
Figure 39B:
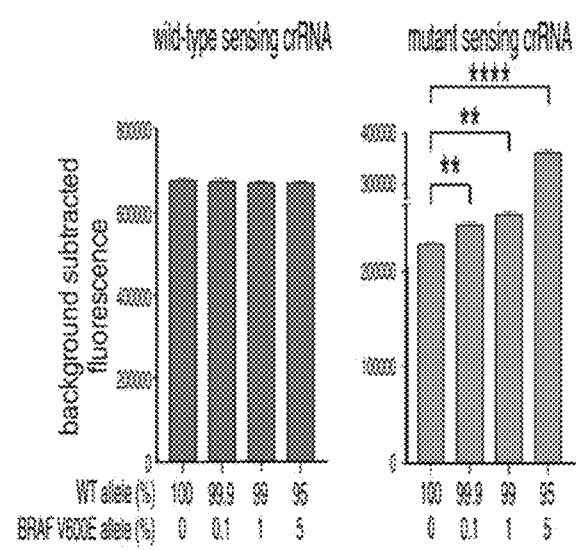

Because the assay could sense synthetic targets with allelic fractions in a clinically relevant range, it was evaluated whether the assay was capable of detecting cancer mutations in cfDNA. RPA primers to two different cancer mutations, EGFR L858R and BRAF V600E, were designed and commercial cfDNA standards were used with allelic fractions of 5%, 1%, and 0.1% that resemble actual human cfDNA samples to test. Using a pair of crRNAs that could distinguish the mutant allele from the wild-type allele (FIG. 38C), detection of the 0.1% allelic fraction for both of the mutant loci was achieved (FIGS. 39A, 39B).

Discussion

By combining the natural properties of C2c2 with isothermal amplification and a quenched fluorescent probe, the assay and systems disclosed herein have been demonstrated as a versatile, robust method to detect RNA and DNA, and suitable for a variety of rapid diagnoses including infectious disease applications and rapid genotyping. A major advantage of the assays and systems disclosed herein is that a new POC test can be redesigned and synthesized in a matter of days for as low as $0.6/test.

Because many human disease applications require the ability to detect single mismatches a rational approach was developed to engineer crRNAs to be highly specific to a single mismatch in the target sequence by introducing a synthetic mismatch in the spacer sequence of the crRNA. Other approaches for achieving specificity with CRISPR effectors rely on screening-based methods over dozens of guide designs (Chavez et al., 2016). Using designed mismatch crRNAs, discrimination of Zika and Dengue viral strains in sites that differ by a single mismatch, rapid genotyping of SNPs from human saliva gDNA, and detection of cancer mutations in cfDNA samples, was demonstrated.

The low cost and adaptability of the assay platform lends itself to further applications including (i) general RNA/DNA quantitation experience in substitute of specific qPCR assays, such as Taqman, (ii) rapid, multiplexed RNA expression detection resembling microarrays, and (iii) other sensitive detection applications, such as detection of nucleic acid contamination from other sources in food. Additionally, C2c2 could potentially be used for detection of transcripts within biological settings, such as in cells, and given the highly specific nature of C2c2 detection, it may be possible to track allelic specific expression of transcripts or disease-associated mutations in live cells. With the wide availability of aptamers, it might also be possible to sense proteins by coupling the detection of protein by an aptamer to the revealing of a cryptic amplification site for RPA followed by C2c2 detection.

Figure 51:
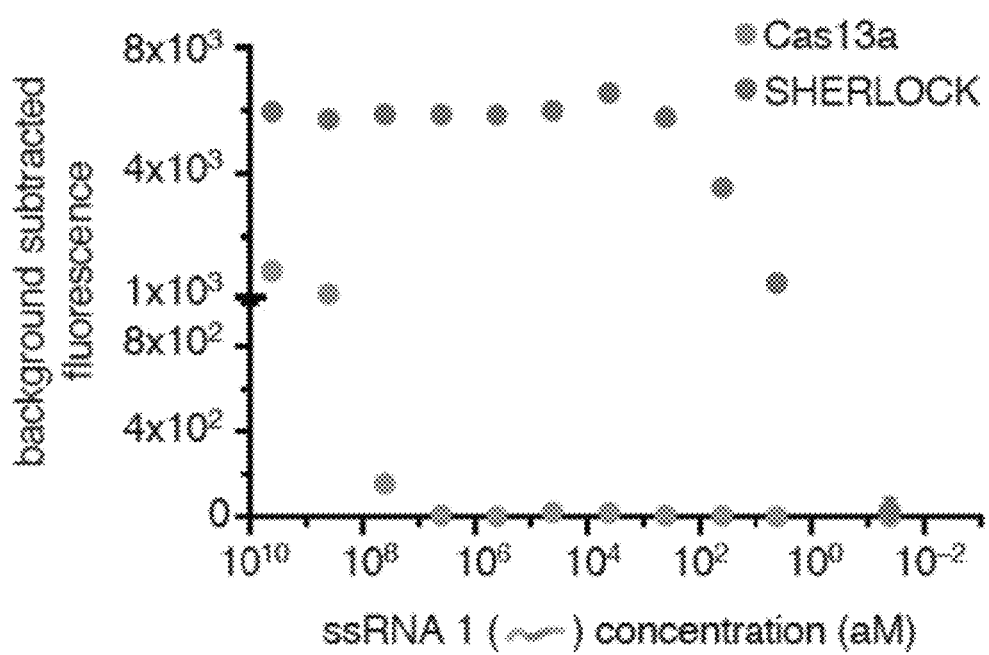
FIG. 51 Cas13a detection of RNA with RPA amplification (SHERLOCK) can detect ssRNA target at concentrations down to ~2 aM, more sensitive than Cas13a alone (n=4 technical replicates; bars represent mean±s.e.m.).

Nucleic Acid Detection with CRISPR-Cas13a/C2c2: Attomolar Sensitivity and Single Nucleotide Specificity To achieve robust signal detection, Applicant identified an ortholog of Cas13a from *Leptotrichia wadei* (LwCas13a), which displays greater RNA-guided RNase activity relative to Leptotrichia shahii Cas13a (LshCas13a) (10) (FIGS. 2A-2F, see also above "Characterization of LwCas13a cleavage requirements"). LwCas13a incubated with ssRNA target 1 (ssRNA 1), crRNA, and reporter (quenched fluorescent RNA) (FIG. 18) (13) yielded a detection sensitivity of ~50 fM (FIGS. 51, 15), which is not sensitive enough for many diagnostic applications (12, 14-16). Applicant therefore explored combining Cas13a-based detection with different isothermal amplification steps (FIGS. 10, 11, 53, 16) (17, 18). Of the methods explored, recombinase polymerase amplification (RPA) (18) afforded the greatest sensitivity and can be coupled with T7 transcription to convert amplified DNA to RNA for subsequent detection by LwCas13a (see also above "Discussion of Recombinase Polymerase Amplification (RPA) and other isothermal amplification strategies."). Applicant refer to this combination of amplification by RPA, T7 RNA polymerase transcription of amplified DNA to RNA, and detection of target RNA by Cas13a collateral RNA cleavage-mediated release of reporter signal as SHERLOCK.

Figure 54A:
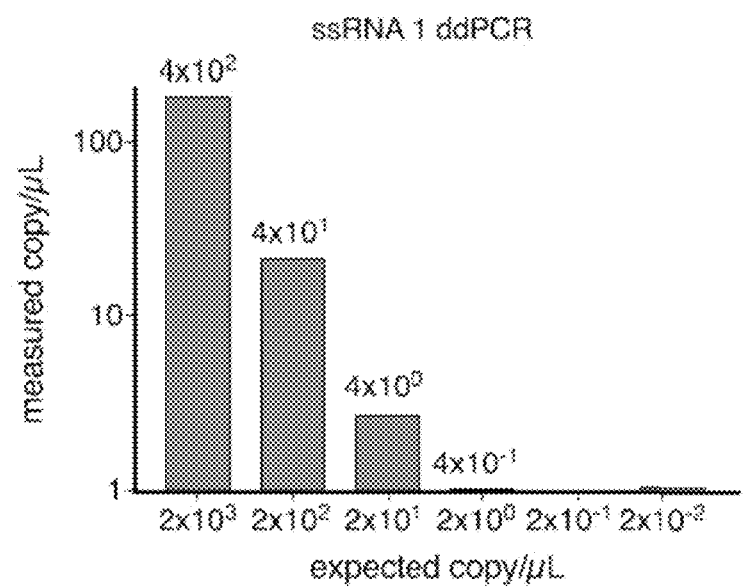
FIGS. 54A-54C illustrate nucleic acid amplification with RPA and single-reaction SHERLOCK.
Figure 54B:
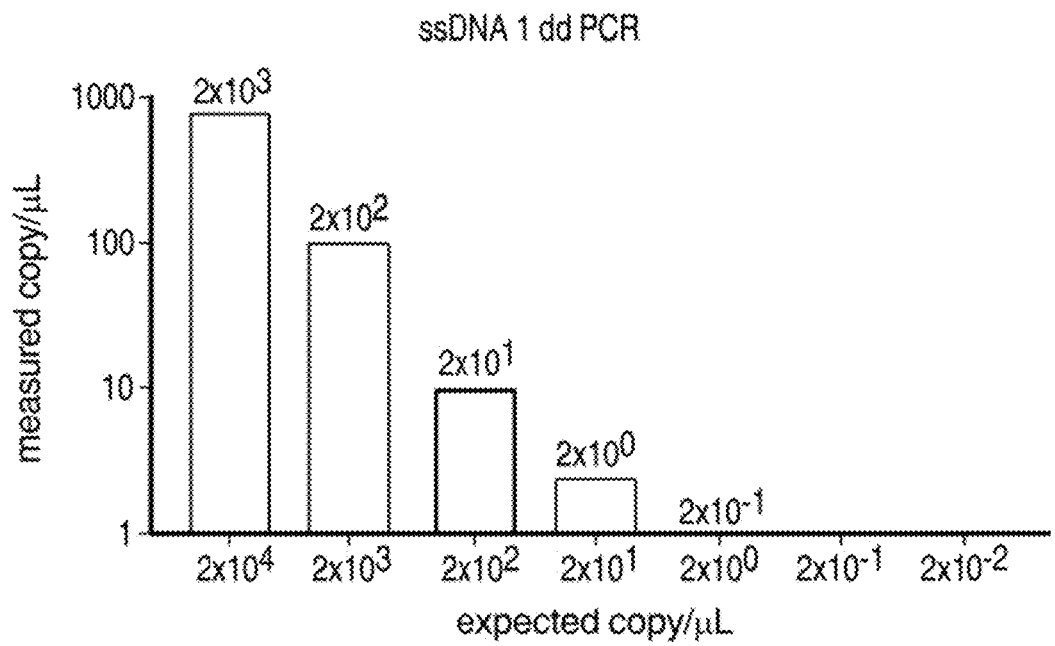
Figure 54C:
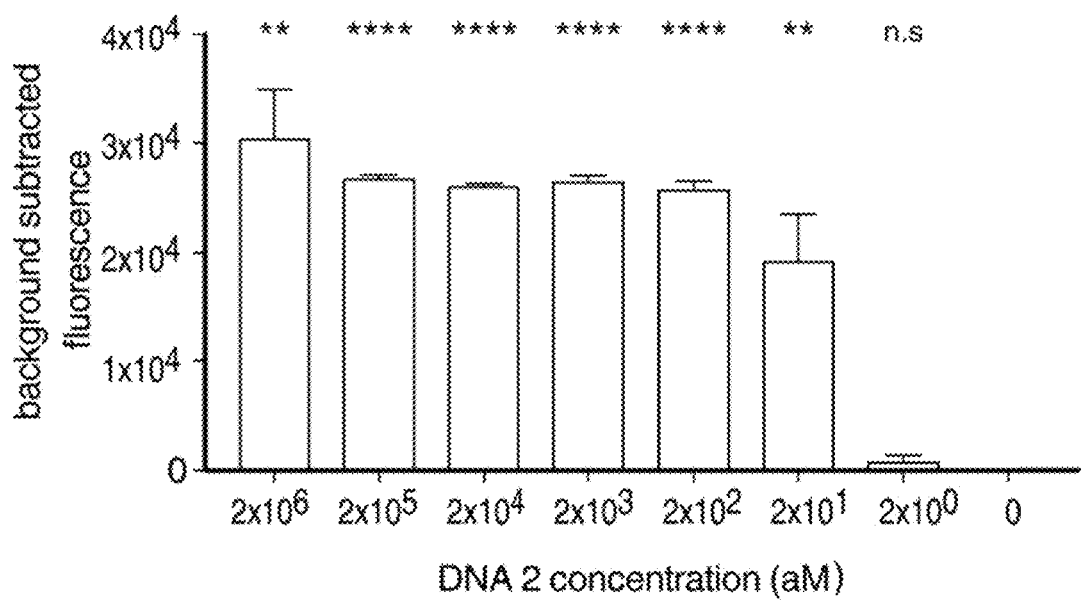
Figure 55A:
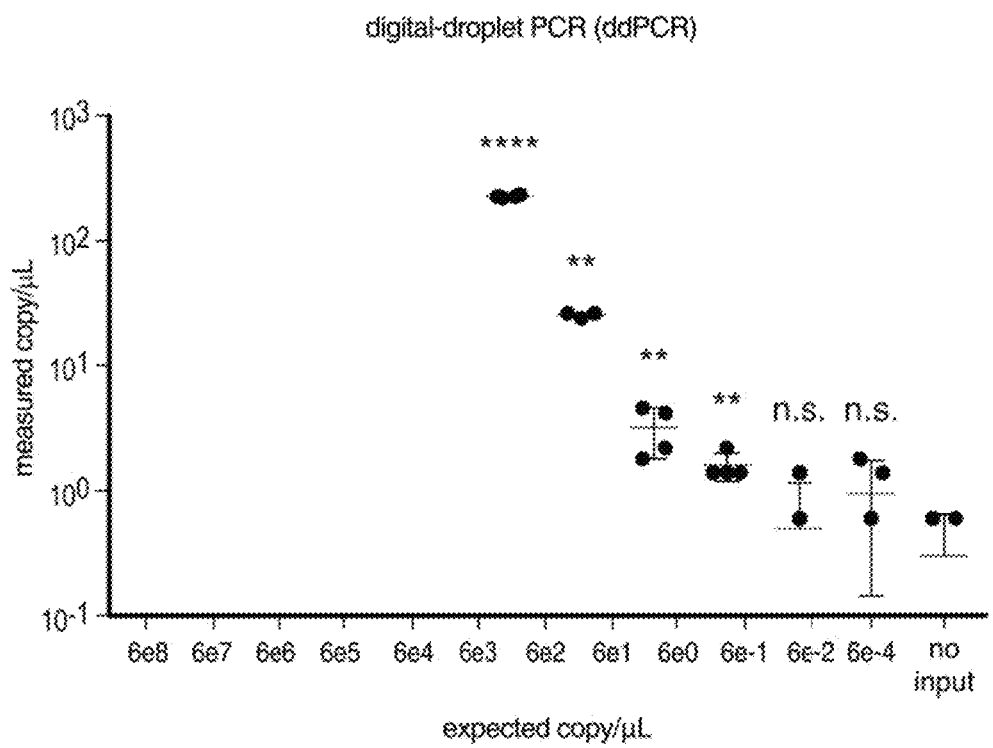
FIGS. 55A-55F show comparison of SHERLOCK to other sensitive nucleic acid detection tools.
Figure 55B:
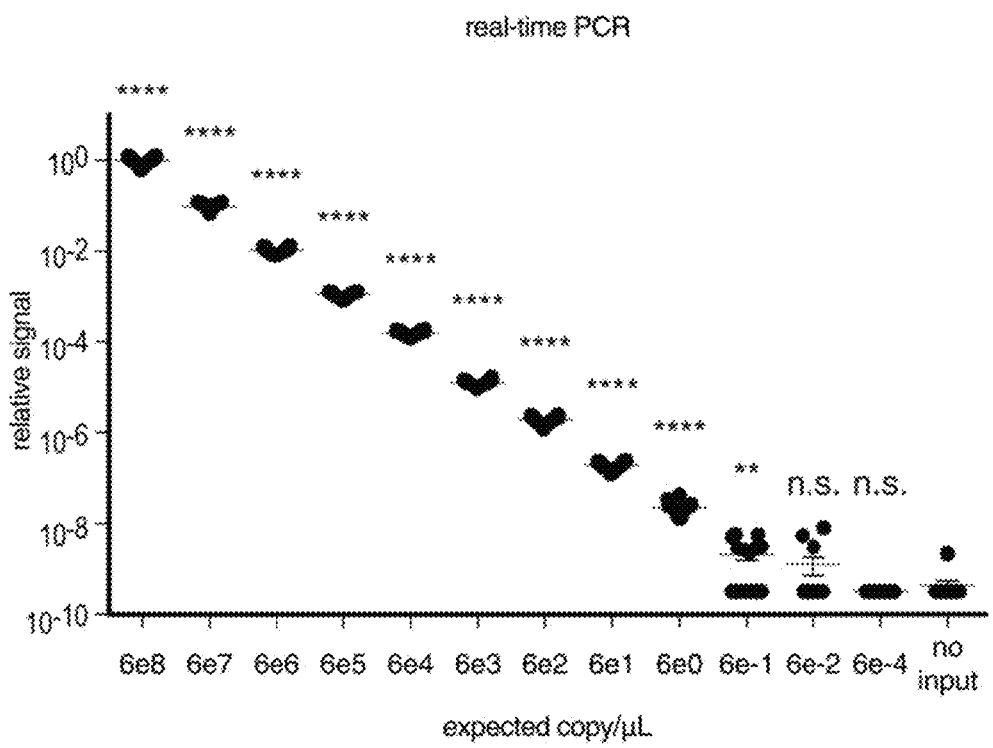
Figure 55C:
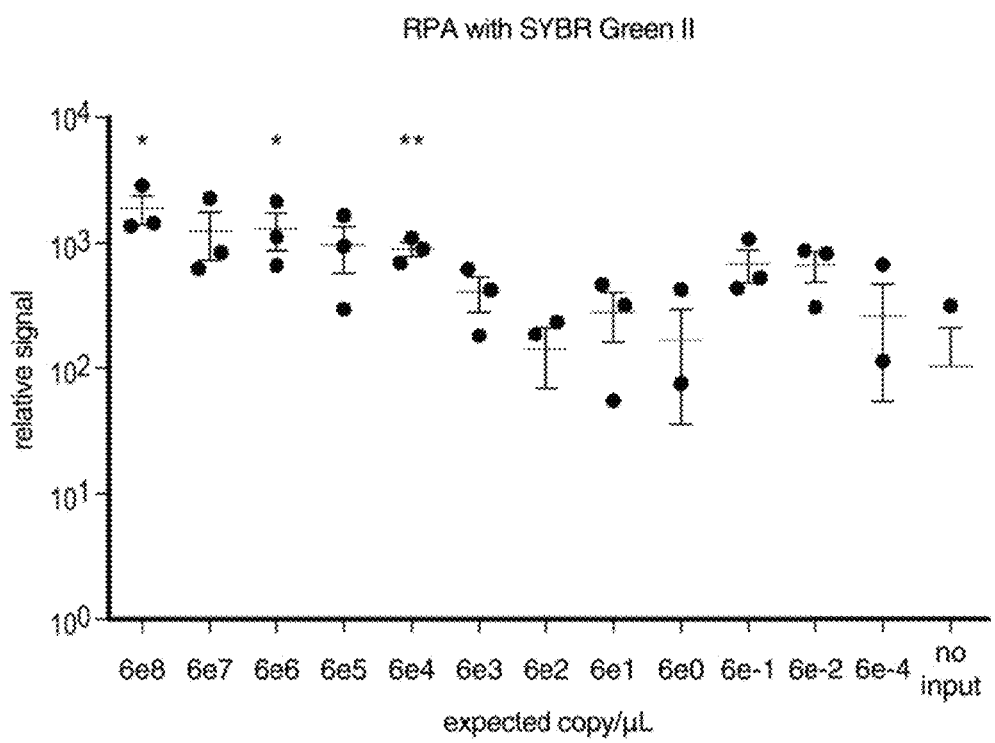
Figure 55D:
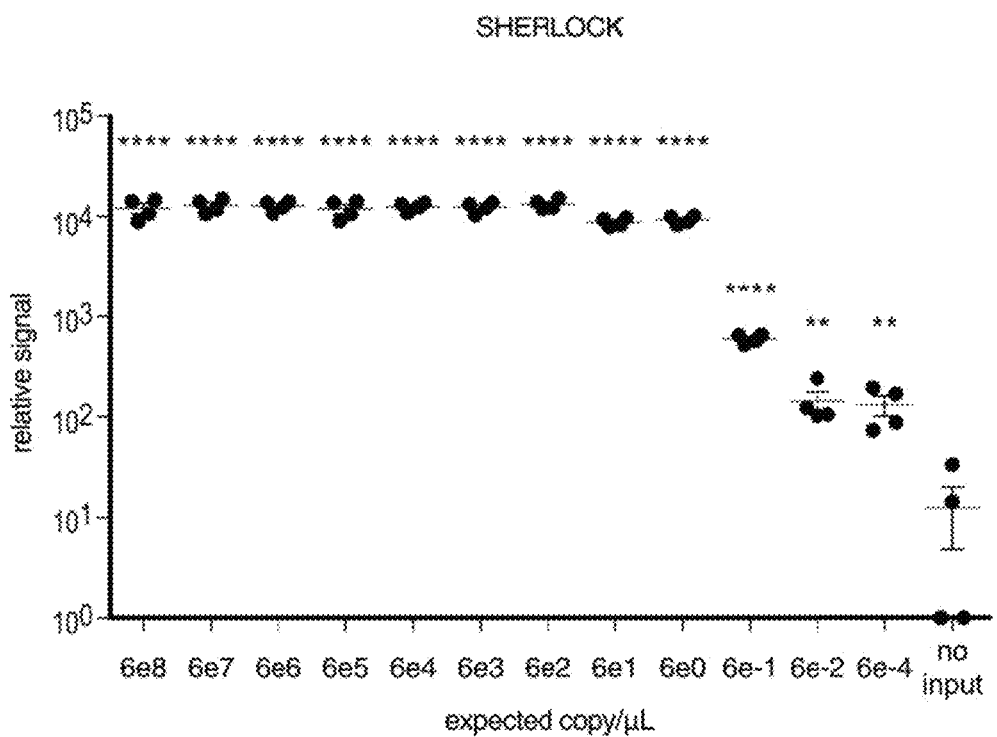
Figure 55E:
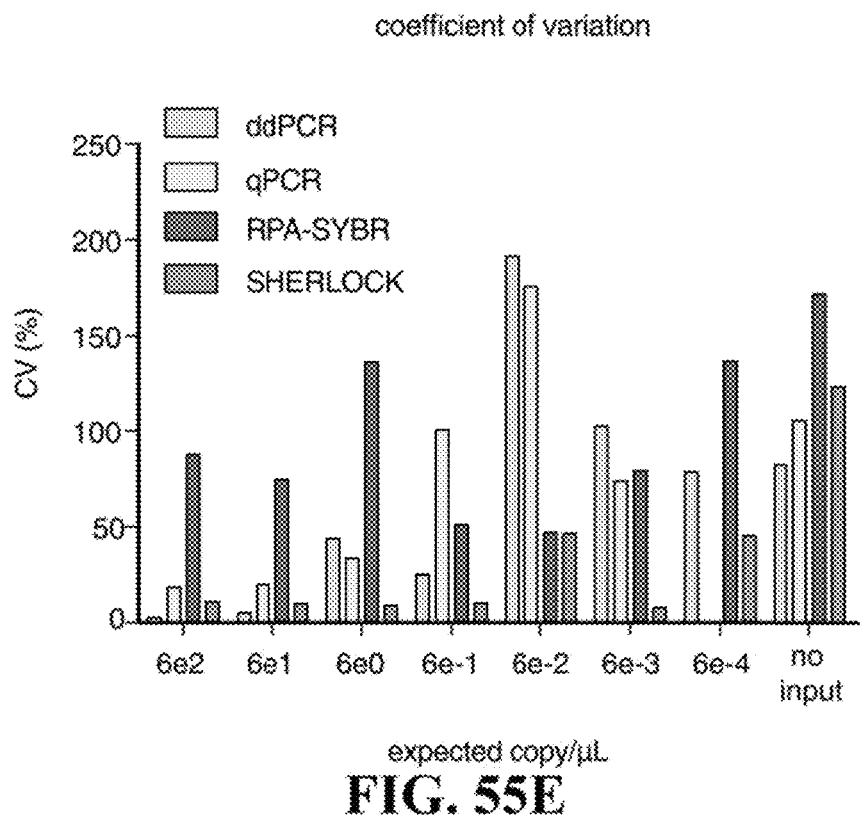
Figure 55F:
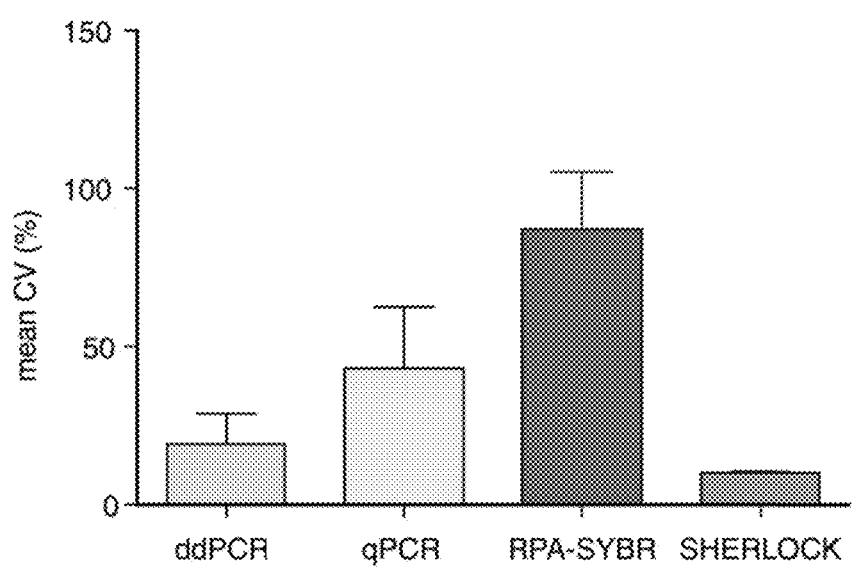

Applicant first determined the sensitivity of SHERLOCK for detection of RNA (when coupled with reverse transcription) or DNA targets. Applicant achieved single molecule sensitivity for both RNA and DNA, as verified by digital-droplet PCR (ddPCR) (FIGS. 27A, 27B, 51, 54A, and 54B). Attomolar sensitivity was maintained when all SHERLOCK components were combined in a single reaction, demonstrating the viability of this platform as a point-of-care (POC) diagnostic (FIG. 54C). SHERLOCK has similar levels of sensitivity as ddPCR and quantitative PCR (qPCR), two established sensitive nucleic acid detection approaches, whereas RPA alone was not sensitive enough to detect low levels of target (FIGS. 55A-55D). Moreover, SHERLOCK shows less variation than ddPCR, qPCR, and RPA, as measured by the coefficient of variation across replicates (FIGS. 55E-55F).

Figure 52A:
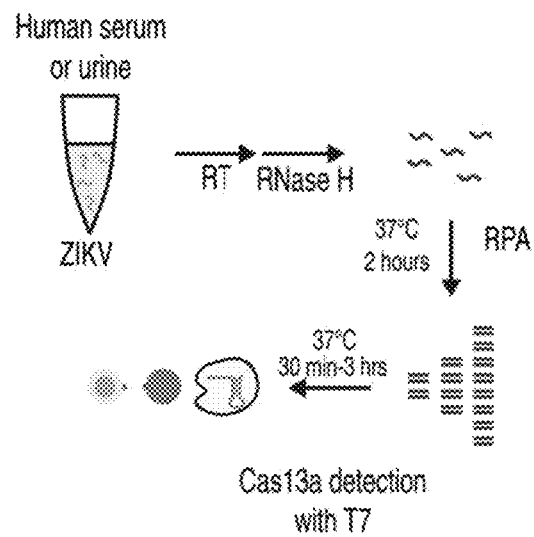
FIGS. 52A and 52B illustrate that Cas13a detection can be used to sense viral and bacterial pathogens.
Figure 52B:
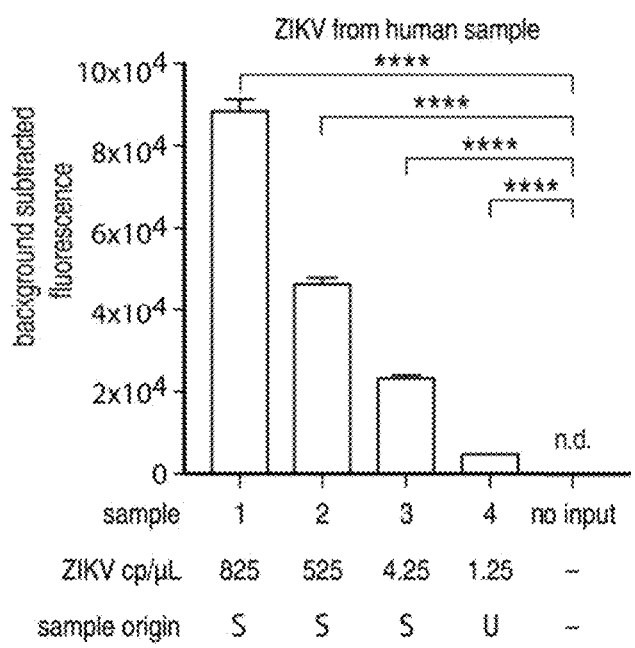
Figure 56:
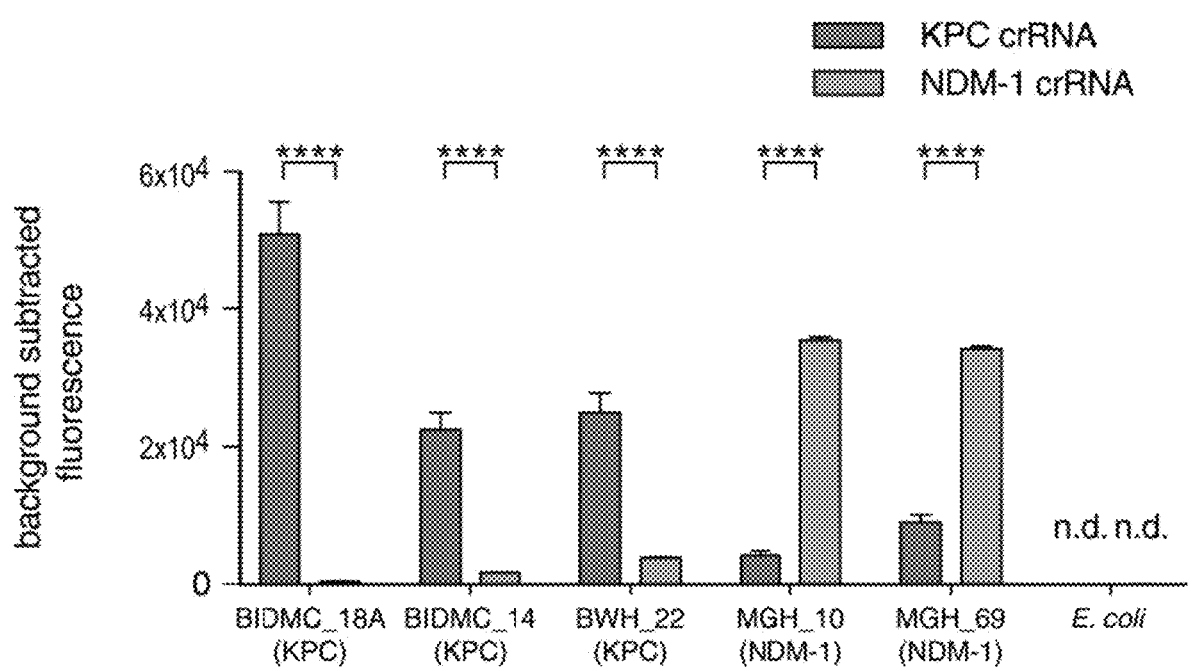
FIG. 56—Detection of carbapenem resistance in clinical bacterial isolates. Detection of two different carbapenem-resistance genes (KPC and NDM-1) from five clinical isolates of *Klebsiella pneumoniae* and an *E. coli* control (n=4 technical replicates, two tailed Student t-test; ****, p<0.0001; bars represent mean±s.e.m.; n.d., not detected).
Figure 57B:
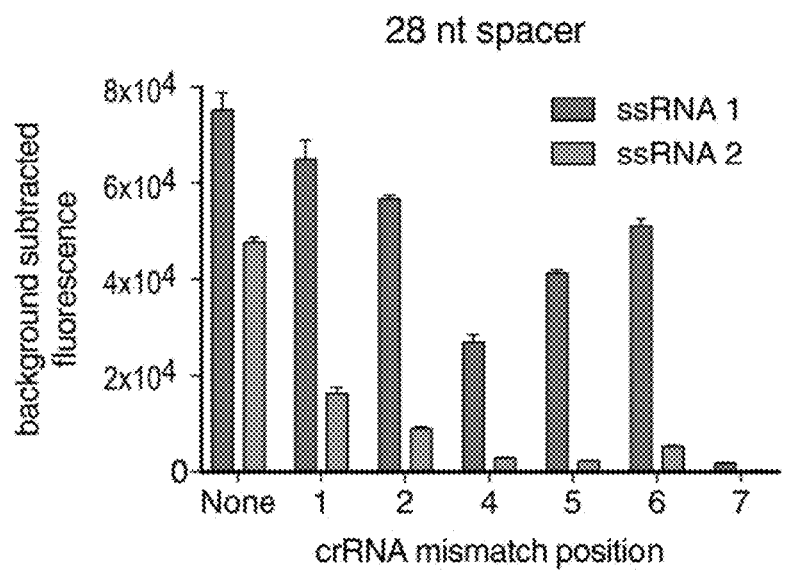
Figure 57C:
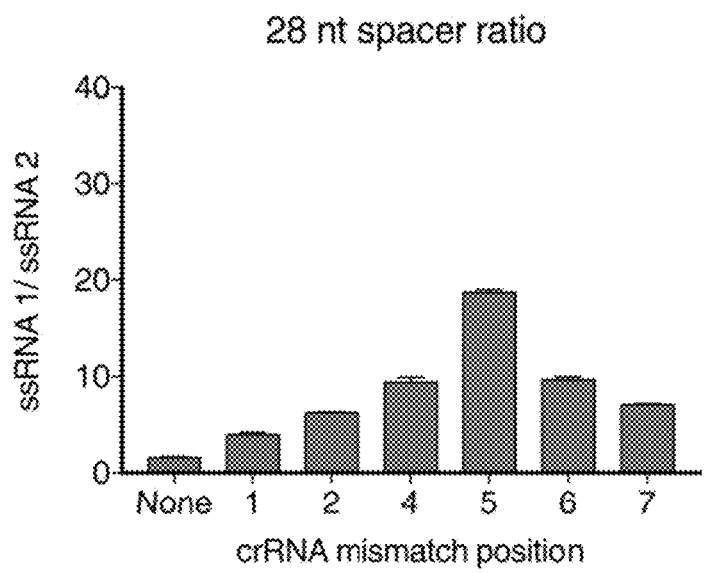
Figure 57D:
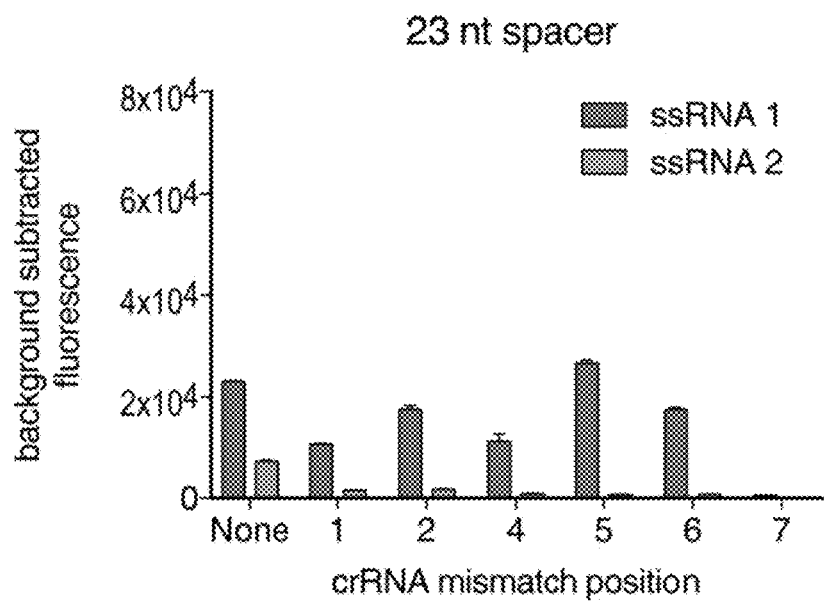
Figure 57E:
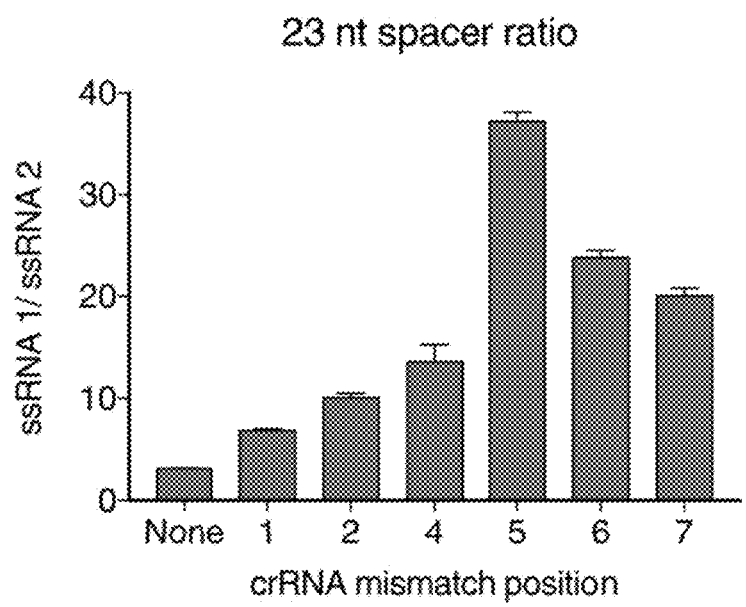
Figure 57F:
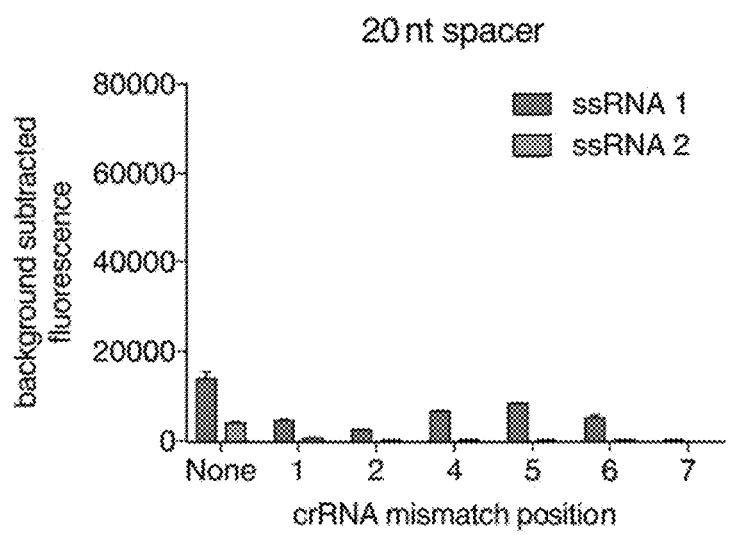
Figure 57G:
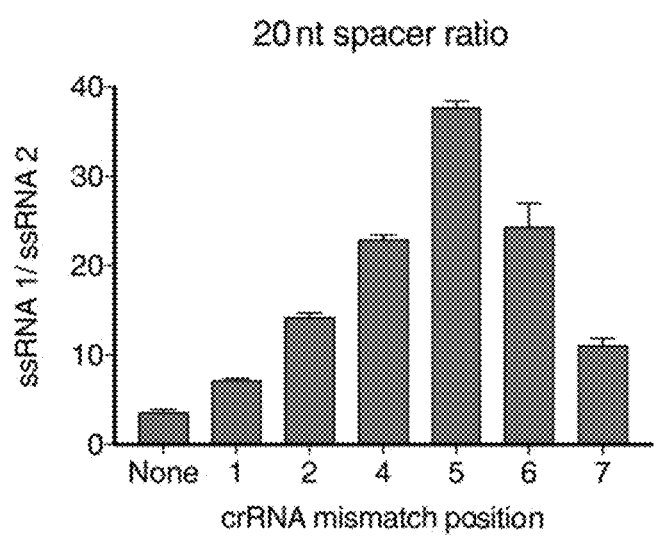

Applicant next examined whether SHERLOCK would be effective in infectious disease applications that require high sensitivity. Applicant produced lentiviruses harboring genome fragments of either Zika virus (ZIKV) or the related flavivirus Dengue (DENV) (19) (FIG. 31A). SHERLOCK detected viral particles down to 2 aM and could discriminate between ZIKV and DENV (FIG. 31B). To explore the potential use of SHERLOCK in the field, Applicant first demonstrated that Cas13a crRNA complexes lyophilized and subsequently rehydrated (20) could detect 20 fM of nonamplified ssRNA 1 (FIG. 33A) and that target detection was also possible on glass fiber paper (FIG. 33B). The other components of SHERLOCK are also amenable to freeze-drying: RPA is provided as a lyophilized reagent at ambient temperature, and Applicant previously demonstrated that T7 polymerase tolerates freeze-drying (2). In combination, freeze-drying and paper-spotting the Cas13a detection reaction resulted in comparable levels of sensitive detection of ssRNA 1 as aqueous reactions (FIGS. 33C-33E). Although paper-spotting and lyophilization slightly reduced the absolute signal of the readout, SHERLOCK (FIG. 31C) could readily detect mock ZIKV virus at concentrations as low as 20 aM (FIG. 31D). SHERLOCK is also able to detect ZIKV in clinical isolates (serum, urine, or saliva) where titers can be as low as 2×103 copies/mL (3.2 aM) (21). ZIKV RNA extracted from patient serum or urine samples and reverse transcribed into cDNA (FIGS. 32A, 32B, and 52A) could be detected at concentrations down to 1.25×103 copies/mL (2.1 aM), as verified by qPCR (FIGS. 32B and 52B). Furthermore, the signal from patient samples was predictive of ZIKV RNA copy number and could be used to predict viral load (FIG. 33F). To simulate sample detection without nucleic acid purification, Applicant measured detection of ssRNA 1 spiked into human serum, and found that Cas13a could detect RNA in reactions containing as much as 2% serum (FIG. 33G). Another important epidemiological application for the embodiments disclosed herein is the identification of bacterial pathogens and detection of specific bacterial genes. Applicant targeted the 16S rRNA gene V3 region, where conserved flanking regions allow universal RPA primers to be used across bacterial species and the variable internal region allows for differentiation of species. In a panel of five possible targeting crRNAs for different pathogenic strains and gDNA isolated from *E. coli* and *Pseudomonas aeruginosa* (FIG. 34A), SHERLOCK correctly genotyped strains and showed low cross-reactivity (FIGS. 34B, 34C). Additionally, Applicant was able to use SHERLOCK to distinguish between clinical isolates of *Klebsiella pneumoniae* with two different resistance genes: *Klebsiella pneumoniae* carbapenemase (KPC) and New Delhi metallo-beta-lactamase 1 (NDM-1) (22) (FIG. 56).

Figure 61:
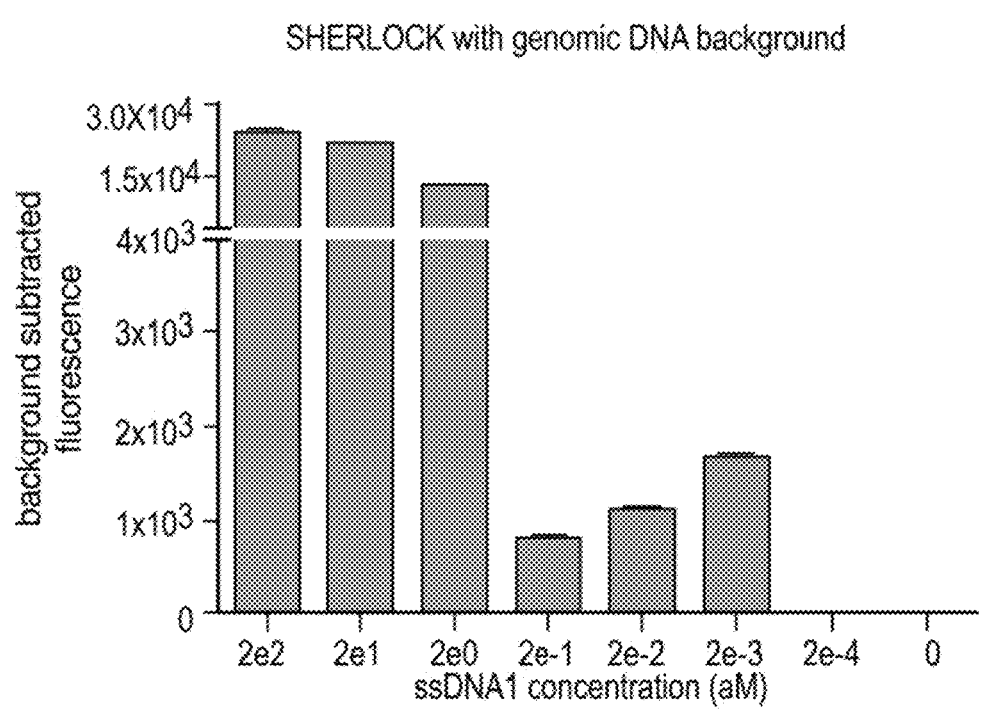
FIG. 61—Detection of ssDNA 1 as a small fraction of mismatched background target. SHERLOCK detection of a dilution series of ssDNA 1 on a background of human genomic DNA. Note that there should be no sequence similarity between the ssDNA 1 target being detected and the background genomic DNA (n=2 technical replicates; bars represent mean±s.e.m.).
Figure 62A:
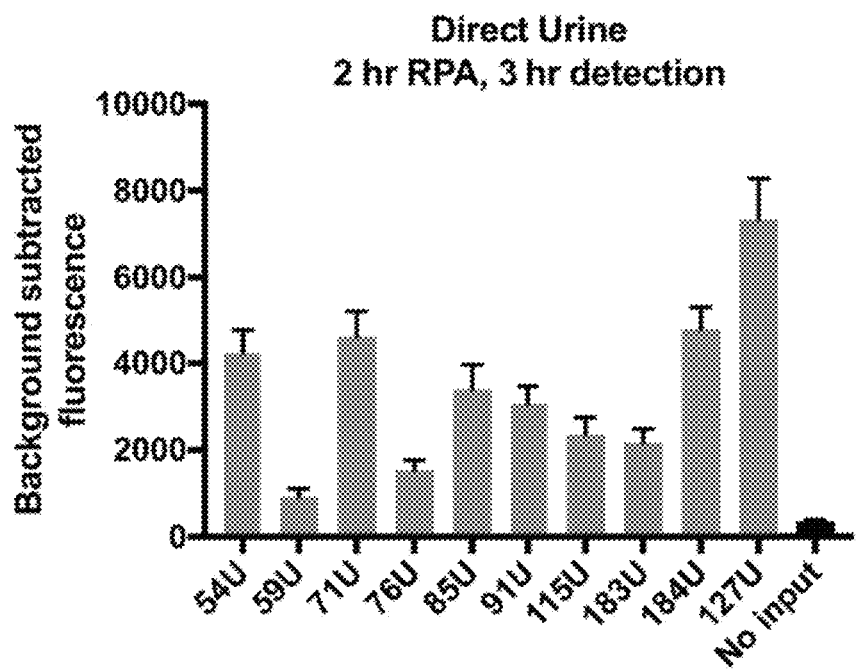
FIG. 62A is a graph showing urine samples from patients with Zika virus that were heat inactivated for 5 minutes at 95° C.
Figure 62B:
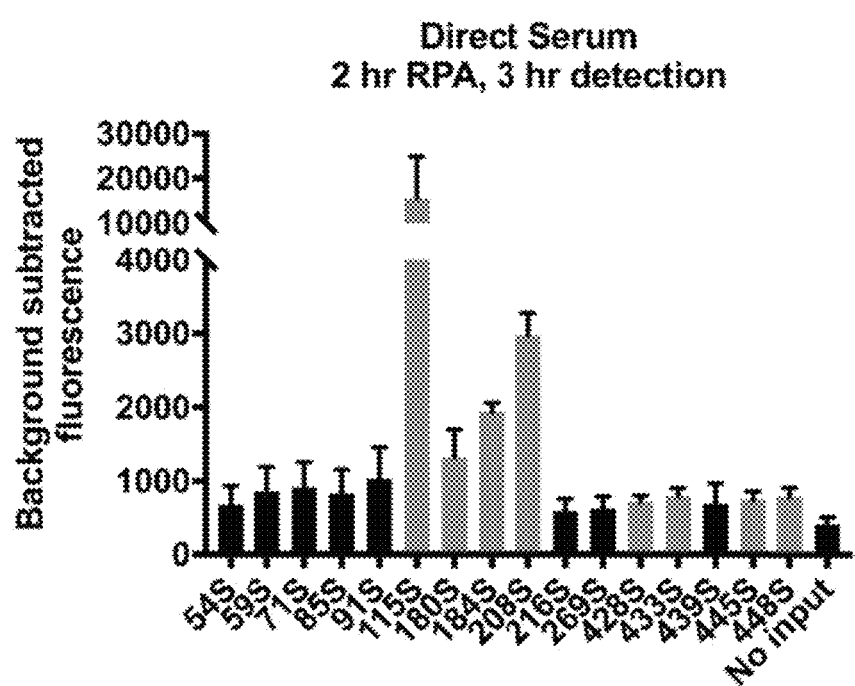
FIG. 62B is a graph showing serum samples from patients with Zika virus that were heat inactivated for 5 minutes at 65° C. One microliter of inactivated urine or serum was used as input for a 2 hr RPA reaction followed by a 3 hour C2c2/Cas13a detection reaction, in accordance with an example embodiment. Error bars indicate 1 SD based on n=4 technical replicates for the detection reaction.
Figure 63A:
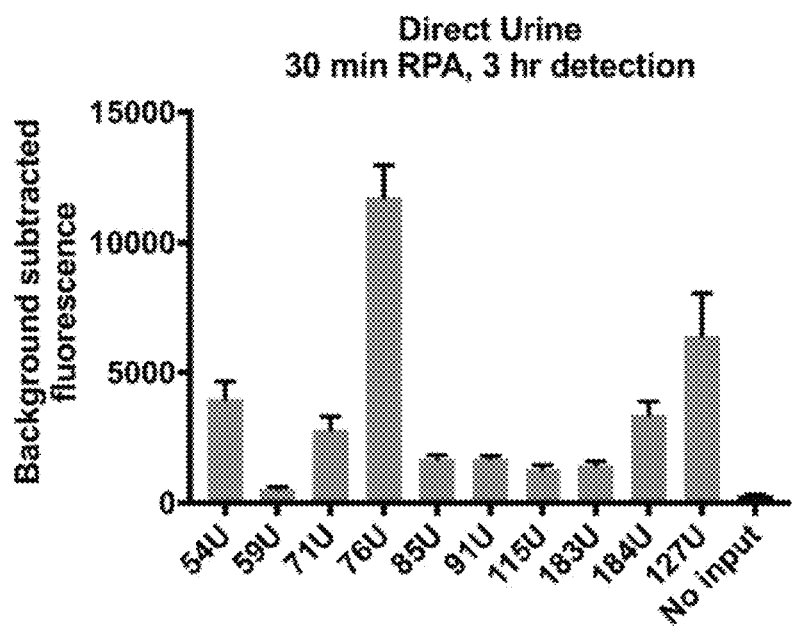
FIGS. 63A, 63B. Urine samples from patients with Zika virus were heat-inactivated for 5 minutes at 95° C. One microliter of inactivated urine was used as input for a 30 minute RPA reaction followed by a 3 hour (FIG. 63A) or 1 hour (FIG. 63B) C2c2/Cas13 detection reaction, in accordance with example embodiments. Error bars indicate 1 SD based on n=4 technical replicates for the detection reaction.
Figure 63B:
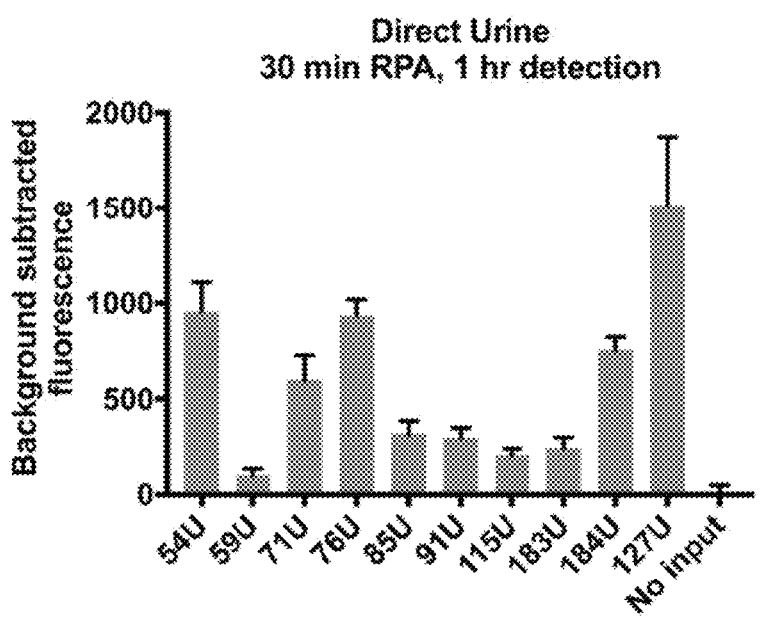
Figure 64:
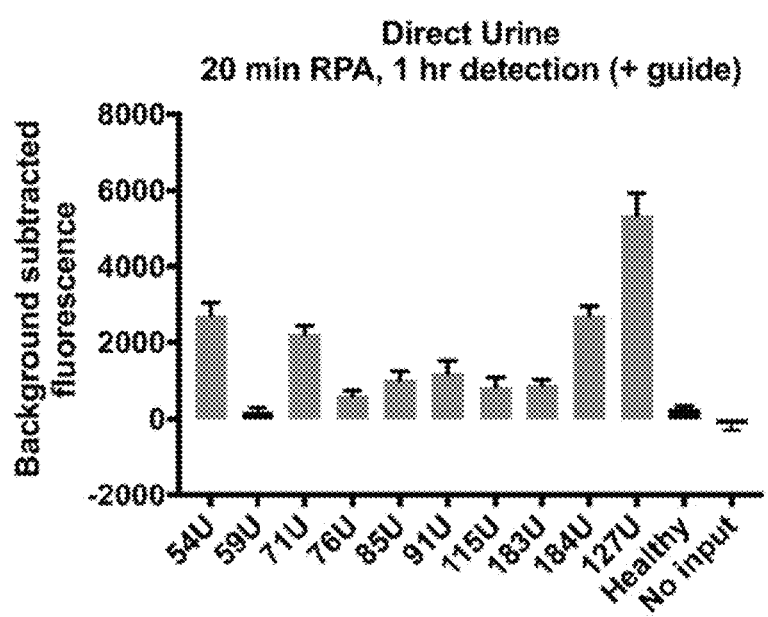
FIG. 64—Urine samples from patients with Zika virus were heat-inactivated for 5 minutes at 95° C. One microliter of inactivated urine was used as input for a 20 minute RPA reaction followed by a 1 hour C2c2/Cas13a detection reaction. Healthy human urine was used as a negative control. Error bars indicate 1 SD based on n=4 technical replicates or the detection reaction.
Figure 65A:
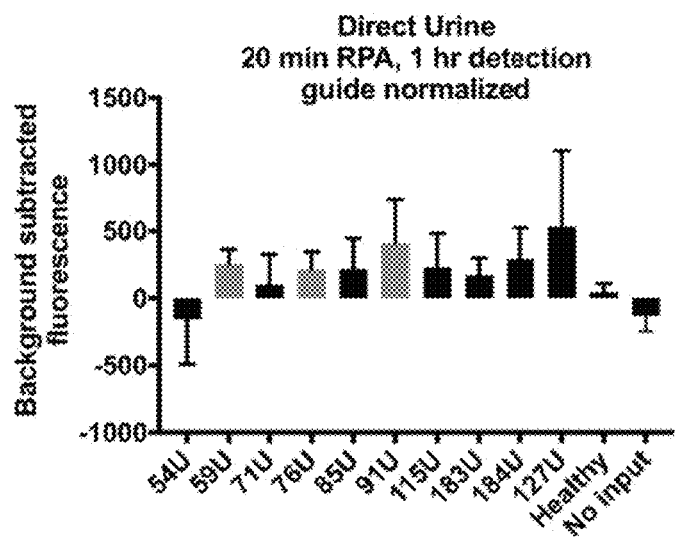
FIGS. 65A, 65B—Urine samples from patients with Zika virus were heat-inactivated for 5 minutes at 95° C. One microliter of inactivated urine was used as input for a 20 minute RPA reaction followed by a 1 hour C2c2/Cas13a detection reaction in the presence or absence of guide RNA. Data are normalized by subtracting the average fluorescence values for no-guide detection reactions from the detection reactions containing guides. Healthy human urine was used as a negative control. Error bars indicate 1 SD based on n=4 technical replicates for the detection reaction.
Figure 65B:
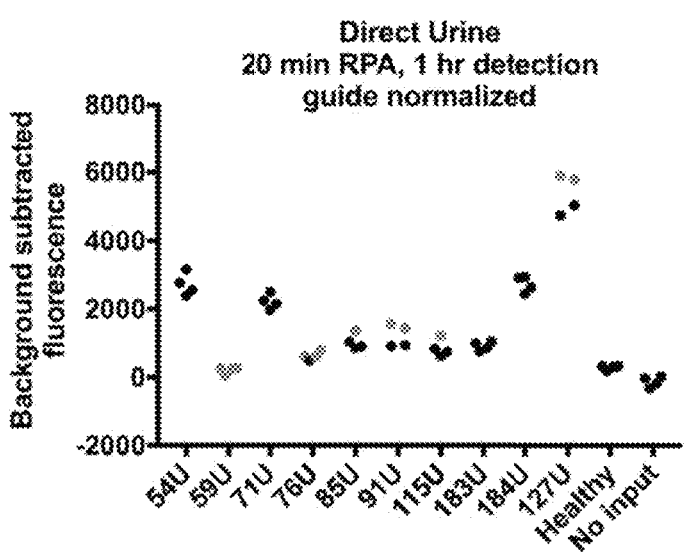
Figure 66:
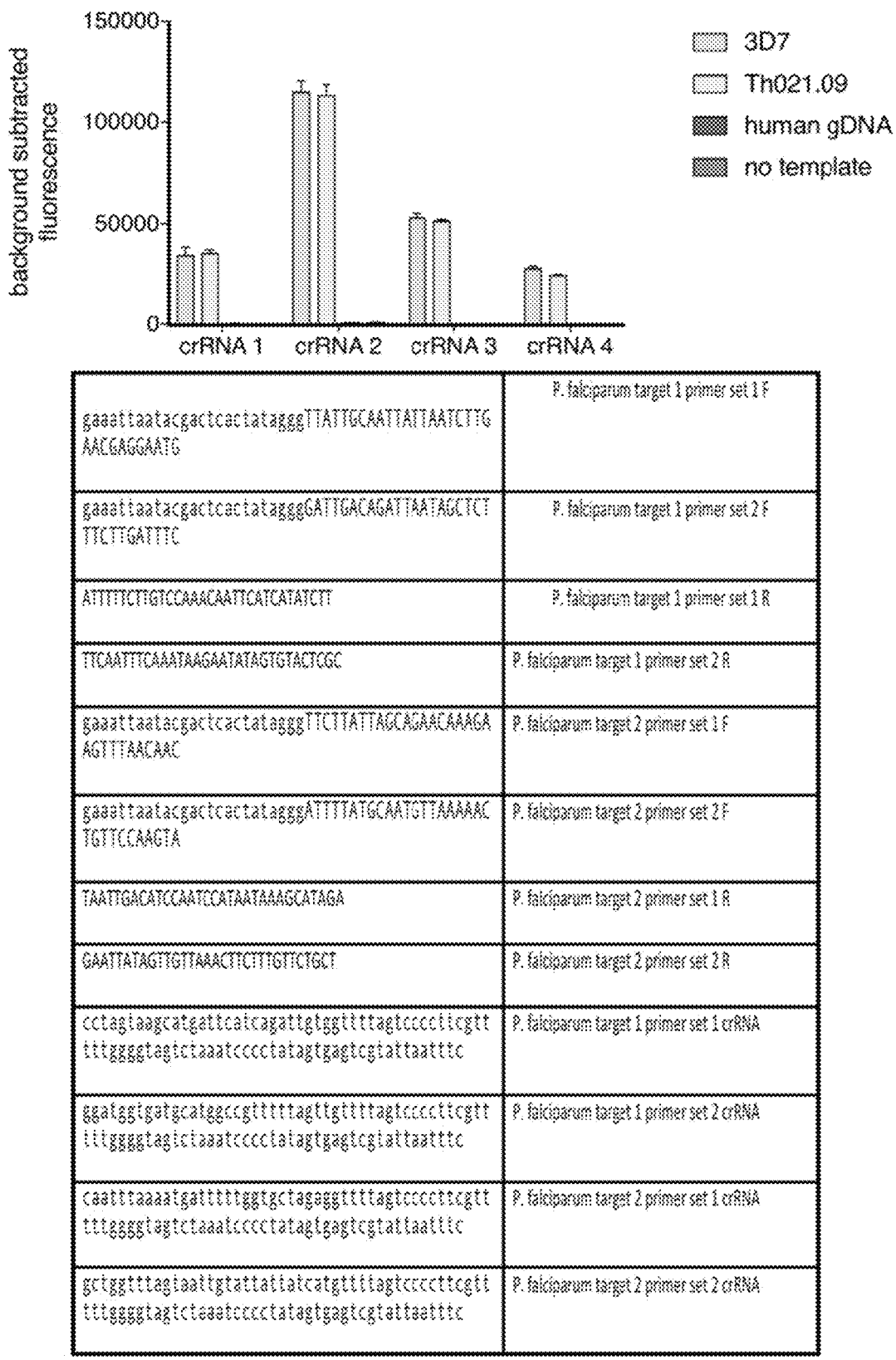
FIG. 66—Shows detection of two malaria specific targets with four different guide RNA designs, in accordance with example embodiments (SEQ. I.D. Nos. 463-474).

To increase the specificity of SHERLOCK, Applicant introduced synthetic mismatches in the crRNA:target duplex that enable LwCas13a to discriminate between targets that differ by a single-base mismatch (FIGS. 36A,B; see also above "Design of Engineered Mismatches"). Applicant designed multiple crRNAs with synthetic mismatches in the spacer sequences to detect either the African or American strains of ZIKV (FIG. 37A) and strain 1 or 3 of DENV (FIG. 37C). Synthetic mismatch crRNAs detected their corresponding strains with significantly higher signal (two-tailed Student t-test; $p<0.01$) than the off-target strain, allowing for robust strain discrimination based off single mismatches (FIGS. 37B, 37D, 36C). Further characterization revealed that Cas13a detection achieves maximal specificity while maintaining on-target sensitivity when a mutation is in position 3 of the spacer and the synthetic mismatch is in position 5 (FIGS. 57A-57G and 58A-58C). The ability to detect single-base differences opens the opportunity of using SHERLOCK for rapid human genotyping. Applicant chose five loci spanning a range of health-related single-nucleotide polymorphisms (SNPs) (Table 1) and benchmarked SHERLOCK detection using 23andMe genotyping data as the gold standard at these SNPs (23) (FIG. 38A). Applicant collected saliva from four human subjects with diverse genotypes across the loci of interest, and extracted genomic DNA either through commercial column purification or direct heating for five minutes (20). SHERLOCK distinguished alleles with high significance and with enough specificity to infer both homozygous and heterozygous genotypes (FIGS. 38B, 40A, 40B, 59, 60A-60E; see also above "Genotyping with SHERLOCK using synthetic standards"). Finally, Applicant sought to determine if SHERLOCK could detect low frequency cancer mutations in cell free (cf) DNA fragments, which is challenging because of the high levels of wild-type DNA in patient blood (24-26). Applicant first found that SHERLOCK could detect ssDNA 1 at attomolar concentrations diluted in a background of genomic DNA (FIG. 61). Next, Applicant found that SHERLOCK was also able to detect single nucleotide polymorphism (SNP)-containing alleles (FIGS. 41A-41B) at levels as low as 0.1% of background DNA, which is in the clinically relevant range. Applicant then demonstrated that SHERLOCK could detect two different cancer mutations, EGFR L858R and BRAF V600E, in mock cfDNA samples with allelic fractions as low as 0.1% (FIGS. 38A-38D and 39A-39B) (20).

The SHERLOCK platform lends itself to further applications including (i) general RNA/DNA quantitation in lieu of specific qPCR assays, such as TaqMan, (ii) rapid, multiplexed RNA expression detection, and (iii) other sensitive detection applications, such as detection of nucleic acid contamination. Additionally, Cas13a could potentially detect transcripts within biological settings and track allele-specific expression of transcripts or disease-associated mutations in live cells. SHERLOCK is a versatile, robust method to detect RNA and DNA, suitable for rapid diagnoses including infectious disease applications and sensitive genotyping. A SHERLOCK paper test can be redesigned and synthesized in a matter of days for as low as $0.61/test (see also above "SHERLOCK is an affordable, adaptable CRISPR-Dx platform") with confidence, as almost every crRNA tested resulted in high sensitivity and specificity. These qualities highlight the power of CRISPR-Dx and open new avenues for rapid, robust and sensitive detection of biological molecules.

TABLE 15

| Name | Sequence | 1st FIG. |
|---|---|---|
| RP0683 - RPA ssDNA/ssRNA 1 F | (SEQ. I.D. No. 18) | FIG. 27B |
| RP0684 - RPA ssDNA/ssRNA 1 R | (SEQ. I.D. No. 19) | FIG. 27B |
| AMPL-25 Zika 8B long-rpa3-f | (SEQ. I.D. No. 20) | FIG. 31B |
| AMPL-26 Zika 8B long-rpa3-r | (SEQ. I.D. No. 21) | FIG. 31B |
| RP819 - zika region 8 F | (SEQ. I.D. No. 22) | FIG. 31C |
| RP821 - zika region 8 R | (SEQ. I.D. No. 23) | FIG. 31C |
| 517 bacterial V3 F | (SEQ. I.D. No. 24) | FIG. 34B |
| RP758 bacterial V3 R | (SEQ. I.D. No. 25) | FIG. 34B |
| wR0074 A2 rs5082 F | (SEQ. I.D. No. 26) | FIG. 38B-38E |
| wR0074 E2 rs5082 R | AA (SEQ. I.D. No. 27) | FIG. 38B-38E |
| wR0074 A4 rs1467558 F | (SEQ. I.D. No. 28) | FIG. 38B-38E |
| wR0074 E4 rs1467558 R | (SEQ. I.D. No. 29) | FIG. 38B-38E |
| wR0074 A5 rs2952768 F | (SEQ. I.D. No. 30) | FIG. 38B-38E |
| wR0074 E5 rs2952768 R | (SEQ. I.D. No. 31) | FIG. 38B-38E |
| wR0074 A9 rs4363657 F | (SEQ. I.D. No. 32) | FIG. 38B-38E |
| wR0074 E9 rs4363657 R | (SEQ. I.D. No. 33) | FIG. 38B-38E |
| wR0074 A11 rs601338 F | (SEQ. I.D. No. 34) | FIG. 38B-38E |
| wR0074 E11 rs601338 R | (SEQ. I.D. No. 35) | FIG. 38B-38E |
| RP824 BRAFV600E cfDNA F | (SEQ. I.D. No. 36) | FIG. 39A, 39B |
| RP769 BRAFV600E cfDNA R | (SEQ. I.D. No. 37) | FIG. 39A, 39B |
| RP826 EGFR858R cfDNA F | (SEQ. I.D. No. 38) | FIG. 39C, 39D |
| RP804 EGFR858R cfDNA R | (SEQ. I.D. No. 39) | FIG. 39C, 39D |
| AMPL-31 T1-nasba1-f | (SEQ. I.D. No. 40) | FIG. 11 |
| AMPL-32 T1-nasba1-r | (SEQ. I.D. No. 41) | FIG. 11 |
| AMPL-33 T1-nasba2-f | (SEQ. I.D. No. 42) | FIG. 11 |
| AMPL-34 T1-nasba2-r | (SEQ. I.D. No. 43) | FIG. 11 |
| AMPL-35 T1-nasba3-f | (SEQ. I.D. No. 44) | FIG. 11 |
| AMPL-36 T1-nasba3-r | (SEQ. I.D. No. 45) | FIG. 11 |
| wR0075 A1 KPC F | (SEQ. I.D. No. 46) | FIG. 35A |
| wR0075 B1 KPC R | (SEQ. I.D. No. 47) | FIG. 35A |
| wR0075 A3 NDM F | (SEQ. I.D. No. 48) | FIG. 35A |
| wR0075 B3 NDM R | (SEQ. I.D. No. 49) | FIG. 35A |

TABLE 16 crRNA sequences used

| Name | Complete crRNA sequence | Spacer sequence | 1st FIG. | PFS |
|---|---|---|---|---|
| Target 1 crRNA | (SEQ. I.D. No. 50) | (SEQ. I.D. No. 51) | FIG. 2F | C |
| Zika targeting crRNA 1 | (SEQ. I.D. No. 52) | (SEQ. I.D. No. 53) | FIG. 31A | U |
| Zika targeting crRNA 2 | (SEQ. I.D. No. 54) | (SEQ. I.D. No. 55) | FIG. 33D | G |
| E. coli detection crRNA | (SEQ. I.D. No. 56) | (SEQ. I.D. No. 57) | FIG. 22B | U |
| K. pneumoniae detection crRNA | (SEQ. I.D. No. 58) | (SEQ. I.D. No. 59) | FIG. 34B | U |
| P. aeruginosa detection crRNA | (SEQ. I.D. No. 60) | (SEQ. I.D. No. 61) | FIG. 34B | U |
| M. tuberculosis detection crRNA | (SEQ. I.D. No. 62) | (SEQ. I.D. No. 63) | FIG. 34B | U |
| S. aureus detection crRNA | (SEQ. I.D. No. 64) | (SEQ. I.D. No. 65) | FIG. 34B | G |
| KPC crRNA | (SEQ. I.D. No. 66) | (SEQ. I.D. No. 67) | FIG. 35A | U |
| NDM crRNA | (SEQ. I.D. No. 68) | (SEQ. I.D. No. 69) | FIG. 35A | C |
| mismatch crRNA 1 | (SEQ. I.D. No. 70) | (SEQ. I.D. No. 71) | FIG. 36A | C |
| mismatch crRNA 2 | (SEQ. I.D. No. 72) | (SEQ. I.D. No. 73) | FIG. 36A | C |
| mismatch crRNA 3 | (SEQ. I.D. No. 74) | (SEQ. I.D. No. 75) | FIG. 36A | C |
| mismatch crRNA 4 | (SEQ. I.D. No. 76) | (SEQ. I.D. No. 77) | FIG. 36A | C |
| mismatch crRNA 5 | (SEQ. I.D. No. 78) | (SEQ. I.D. No. 79) | FIG. 36A | C |
| mismatch crRNA 6 | (SEQ. I.D. No. 80) | (SEQ. I.D. No. 81) | FIG. 36A | C |
| mismatch crRNA 7 | (SEQ. I.D. No. 82) | (SEQ. I.D. No. 83) | FIG. 36A | C |
| mismatch crRNA 8 | (SEQ. I.D. No. 84) | (SEQ. I.D. No. 85) | FIG. 36A | C |
| mismatch crRNA 9 | (SEQ. I.D. No. 86) | (SEQ. I.D. No. 87) | FIG. 36A | C |
| mismatch crRNA 10 | (SEQ. I.D. No. 88) | (SEQ. I.D. No. 89) | FIG. 36A | C |
| African crRNA 1 | (SEQ. I.D. No. 90) | (SEQ. I.D. No. 91) | FIG. 38A | C |
| African crRNA 2 | (SEQ. I.D. No. 92) | (SEQ. I.D. No. 93) | FIG. 38A | C |
| American crRNA 1 | (SEQ. I.D. No. 94) | (SEQ. I.D. No. 95) | FIG. 38A | U |
| American crRNA 2 | (SEQ. I.D. No. 96) | (SEQ. I.D. No. 97) | FIG. 38A | U |
| Dengue strain 3 crRNA 1 | (SEQ. I.D. No. 98) | (SEQ. I.D. No. 99) | FIG. 38F | A |
| Dengue strain 3 crRNA 2 | (SEQ. I.D. No. 100) | (SEQ. I.D. No. 101) | FIG. 38F | A |
| Dengue strain 1 crRNA 1 | (SEQ. I.D. No. 102) | (SEQ. I.D. No. 103) | FIG. 38F | A |
| Dengue strain 1 crRNA 2 | (SEQ. I.D. No. 104) | (SEQ. I.D. No. 105) | FIG. 38F | A |
| Shorter African crRNA 1 | (SEQ. I.D. No. 106) | (SEQ. I.D. No. 107) | FIG. 36C | C |

TABLE 16-continued crRNA sequences used

| Name | Complete crRNA sequence | Spacer sequence | 1st FIG. | PFS |
|---|---|---|---|---|
| Shorter African crRNA 2 | (SEQ. I.D. No. 108) | (SEQ. I.D. No. 109) | FIG. 36C | C |
| Shorter American crRNA 1 | (SEQ. I.D. No. 110) | (SEQ. I.D. No. 111) | FIG. 36C | U |
| Shorter American crRNA 2 | (SEQ. I.D. No. 112) | (SEQ. I.D. No. 113) | FIG. 36C | U |
| rs1467558 crRNA C | (SEQ. I.D. No. 114) | (SEQ. I.D. No. 115) | FIG. 38B-38E | C |
| rs1467558 crRNA T | (SEQ. I.D. No. 116) | (SEQ. I.D. No. 117) | FIG. 38B-38E | C |
| rs2952768 crRNA C | (SEQ. I.D. No. 118) | (SEQ. I.D. No. 119) | FIG. 38B-38E | A |
| rs2952768 crRNA T | (SEQ. I.D. No. 120) | (SEQ. I.D. No. 121) | FIG. 38B-38E | A |
| rs4363657 crRNA C | (SEQ. I.D. No. 122) | (SEQ. I.D. No. 123) | FIG. 38B-38E | A |
| rs4363657 crRNA T | (SEQ. I.D. No. 124) | (SEQ. I.D. No. 125) | FIG. 38B-38E | A |
| rs601338 crRNA A | (SEQ. I.D. No. 126) | (SEQ. I.D. No. 127) | FIG. 38B-38E | G |
| rs601338 crRNA G | (SEQ. I.D. No. 128) | (SEQ. I.D. No. 129) | FIG. 38B-38E | G |
| rs5082 crRNA G | (SEQ. I.D. No. 130) | (SEQ. I.D. No. 131) | FIG. 40A | A |
| rs5082 crRNA A | (SEQ. I.D. No. 132) | | | A |
| EGFR L858R wild-type crRNA | (SEQ. I.D. No. 134) | (SEQ. I.D. No. 135) | FIG. 38F | C |
| EGFRL858R mutant crRNA | (SEQ. I.D. No. 136) | (SEQ. I.D. No. 137) | FIG. 38F | C |
| BRAF V600E wild-type crRNA | (SEQ. I.D. No. 138) | (SEQ. I.D. No. 139) | FIG. 38F | A |
| BRAF V600E mutant crRNA | (SEQ. I.D. No. 140) | (SEQ. I.D. No. 141) | FIG. 38F | A |
| 23 nt mismatch crRNA 1 | (SEQ. I.D. No. 303) | (SEQ. I.D. No. 304) | FIG. 57D | C |
| 23 nt mismatch crRNA 2 | (SEQ. I.D. No. 305) | (SEQ. I.D. No. 306) | FIG. 57D | C |
| 23 nt mismatch crRNA 4 | (SEQ. I.D. No. 307) | (SEQ. I.D. No. 308) | FIG. 57D | C |
| 23 nt mismatch crRNA 5 | (SEQ. I.D. No. 234) | (SEQ. I.D. No. 235) | FIG. 57D | C |
| 23 nt mismatch crRNA 6 | (SEQ. I.D. No. 236) | (SEQ. I.D. No. 237) | FIG. 57D | C |
| 23 nt mismatch crRNA 7 | (SEQ. I.D. No. 238) | (SEQ. I.D. No. 239) | FIG. 57D | C |
| 20 nt mismatch crRNA 1 | (SEQ. I.D. No. 240) | (SEQ. I.D. No. 241) | FIG. 57F | C |
| 20 nt mismatch crRNA 2 | (SEQ. I.D. No. 242) | (SEQ. I.D. No. 243) | FIG. 57F | C |
| 20 nt mismatch crRNA 4 | (SEQ. I.D. No. 244) | (SEQ. I.D. No. 245) | FIG. 57F | C |
| 20 nt mismatch crRNA 5 | (SEQ. I.D. No. 246) | (SEQ. I.D. No. 247) | FIG. 57F | C |
| 20 nt mismatch crRNA 6 | (SEQ. I.D. No. 248) | (SEQ. I.D. No. 249) | FIG. 57F | C |
| 20 nt mismatch crRNA 7 | (SEQ. I.D. No. 250) | (SEQ. I.D. No. 251) | FIG. 57F | C |
| target mismatch 4 mismatch crRNA 1 | (SEQ. I.D. No. 252) | (SEQ. I.D. No. 253) | FIG. 58B | C |
| target mismatch 4 mismatch crRNA 2 | (SEQ. I.D. No. 254) | (SEQ. I.D. No. 255) | FIG. 58B | C |
| target mismatch 4 mismatch crRNA 3 | (SEQ. I.D. No. 256) | (SEQ. I.D. No. 257) | FIG. 58B | C |
| target mismatch 4 mismatch crRNA 5 | (SEQ. I.D. No. 258) | (SEQ. I.D. No. 259) | FIG. 58B | C |
| target mismatch 4 mismatch crRNA 6 | SEQ. I.D. No. 260) | (SEQ. I.D. No. 261) | FIG. 58B | C |
| target mismatch 4 mismatch crRNA 7 | (SEQ. I.D. No. 262) | (SEQ. I.D. No. 263) | FIG. 58B | C |

TABLE 16-continued crRNA sequences used

| Name | Complete crRNA sequence | Spacer sequence | 1st FIG. | PFS |
|---|---|---|---|---|
| target mismatch 5 mismatch crRNA 2 | (SEQ. I.D. No. 264) | (SEQ. I.D. No. 265) | FIG. 58B | C |
| target mismatch 5 mismatch crRNA 3 | (SEQ. I.D. No. 266) | (SEQ. I.D. No. 267) | FIG. 58B | C |
| target mismatch 5 mismatch crRNA 4 | (SEQ. I.D. No. 268) | (SEQ. I.D. No. 269) | FIG. 58B | C |
| target mismatch 5 mismatch crRNA 6 | (SEQ. I.D. No. 270) | (SEQ. I.D. No. 271) | FIG. 58B | C |
| target mismatch 5 mismatch crRNA 7 | (SEQ. I.D. No. 272) | (SEQ. I.D. No. 273) | FIG. 58B | C |
| target mismatch 5 mismatch crRNA 8 | (SEQ. I.D. No. 274) | (SEQ. I.D. No. 275) | FIG. 58B | C |
| target mismatch 6 mismatch crRNA 3 | (SEQ. I.D. No. 276) | (SEQ. I.D. No. 277) | FIG. 58B | C |
| target mismatch 6 mismatch crRNA 4 | (SEQ. I.D. No. 278) | (SEQ. I.D. No. 279) | FIG. 58B | C |
| target mismatch 6 mismatch crRNA 5 | (SEQ. I.D. No. 280) | (SEQ. I.D. No. 281) | FIG. 58B | C |
| target mismatch 6 mismatch crRNA 7 | (SEQ. I.D. No. 282) | (SEQ. I.D. No. 283) | FIG. 58B | C |
| target mismatch 6 mismatch crRNA 8 | (SEQ. I.D. No. 284) | (SEQ. I.D. No. 285) | FIG. 58B | C |
| target mismatch 6 mismatch crRNA 9 | (SEQ. I.D. No. 286) | (SEQ. I.D. No. 287) | FIG. 58B | C |

TABLE 17

RNA and DNA targets used in this Example

| Name | Sequence | 1st FIG. |
|---|---|---|
| ssRNA 1 (C PFS) | (SEQ. I.D. No. 288) | FIG. 2F |
| ssRNA 1 (G PFS) | (SEQ. I.D. No. 289) | FIG. 2F |
| ssRNA 1 (A PFS) | (SEQ. I.D. No. 290) | FIG. 2F |
| ssRNA 1 (U PFS) | (SEQ. I.D. No. 291) | FIG. 2F |
| ssDNA 1 | (SEQ. I.D. No. 292) | FIGS. 27A, 27B |
| DNA 2 | (SEQ. I.D. No. 293) | FIG. 54B |
| ZIKV in lentivirus | (SEQ. I.D. No. 294) | FIG. 31B |
| DENV in lentivirus | (SEQ. I.D. No. 295) | FIG. 31B |
| Synthetic ZIKV target | (SEQ. I.D. No. 296) | FIG. 33D |
| Synthetic African ZIKV target | (SEQ. I.D. No. 297) | FIGS. 37A, 37B |
| Synthetic American ZIKV target | (SEQ. I.D. No. 298) | FIGS. 37A, 37B |
| Synthetic Dengue strain 1 target | (SEQ. I.D. No. 299) | FIGS. 37D, 37E |
| Synthetic Dengue strain 3 target | (SEQ. I.D. No. 300) | FIGS. 37D, 37E |
| ssRNA 2 | (SEQ. I.D. No. 301) | FIG. 36A |
| ssRNA 3 | (SEQ. I.D. No. 302) | FIG. 36A |

TABLE 18 plasmids used in this Example

| Plasmid Name | Description | Link to plasmid map |
|---|---|---|
| pC004 | beta-lactamase screening target | https://benchling.com/s/1PJ1cCwR |
| pC009 | LshCas13a locus into pACYC184 with targeting spacer | https://benchling.com/s/seqylkMug1YmiG4A3VhShZg |
| pC010 | LshCas13a locus into pACYC184 with nontargeting spacer | https://benchling.com/s/seq-2WApFr3zni1GOACyQY8a |
| pC011 | LwCas13a locus into pACYC184 with targeting spacer | https://benchling.com/s/seq-Vyk8qK2fyhzegfNgLJHM |
| pC012 | LwCas13a locus into pACYC184 with nontargeting spacer | https://benchling.com/s/seq-RxZAgPBzBUGQThkxR2Kx |

TABLE 18-continued plasmids used in this Example

| Plasmid Name | Description | Link to plasmid map |
|---|---|---|
| pC013 | Twinstrep-SUMO-huLwCas13a for bacterial expression | https://benchling.com/s/seq-66CfLwu7sLMQMbcXe7Ih |

Example 3—Characterization of Cas13b Orthologs with Orthogonal Base Preferences

Figure 83A:
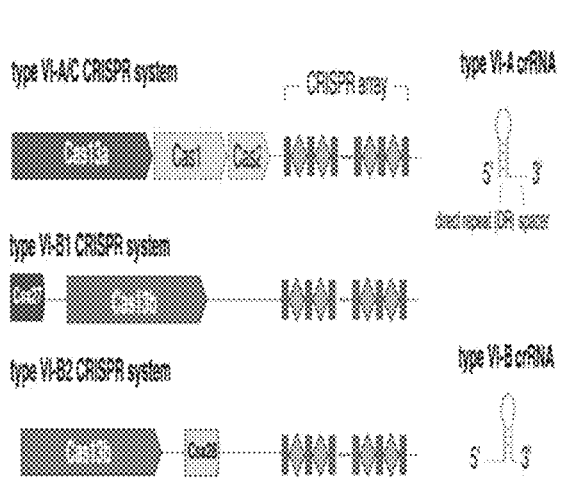
Figure 83B:
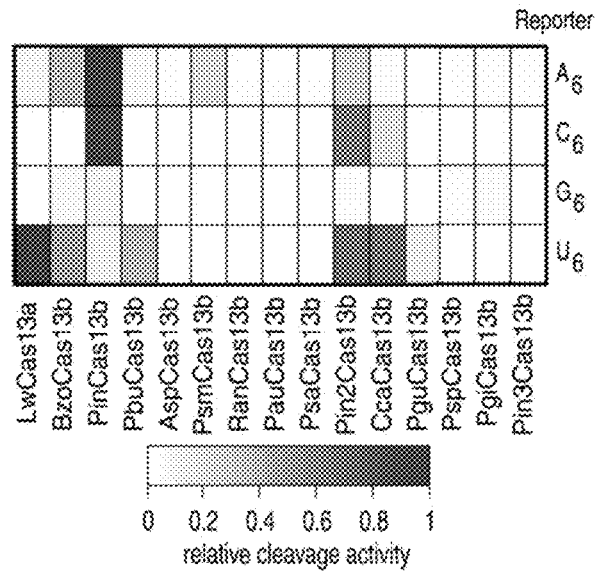
Figure 85:
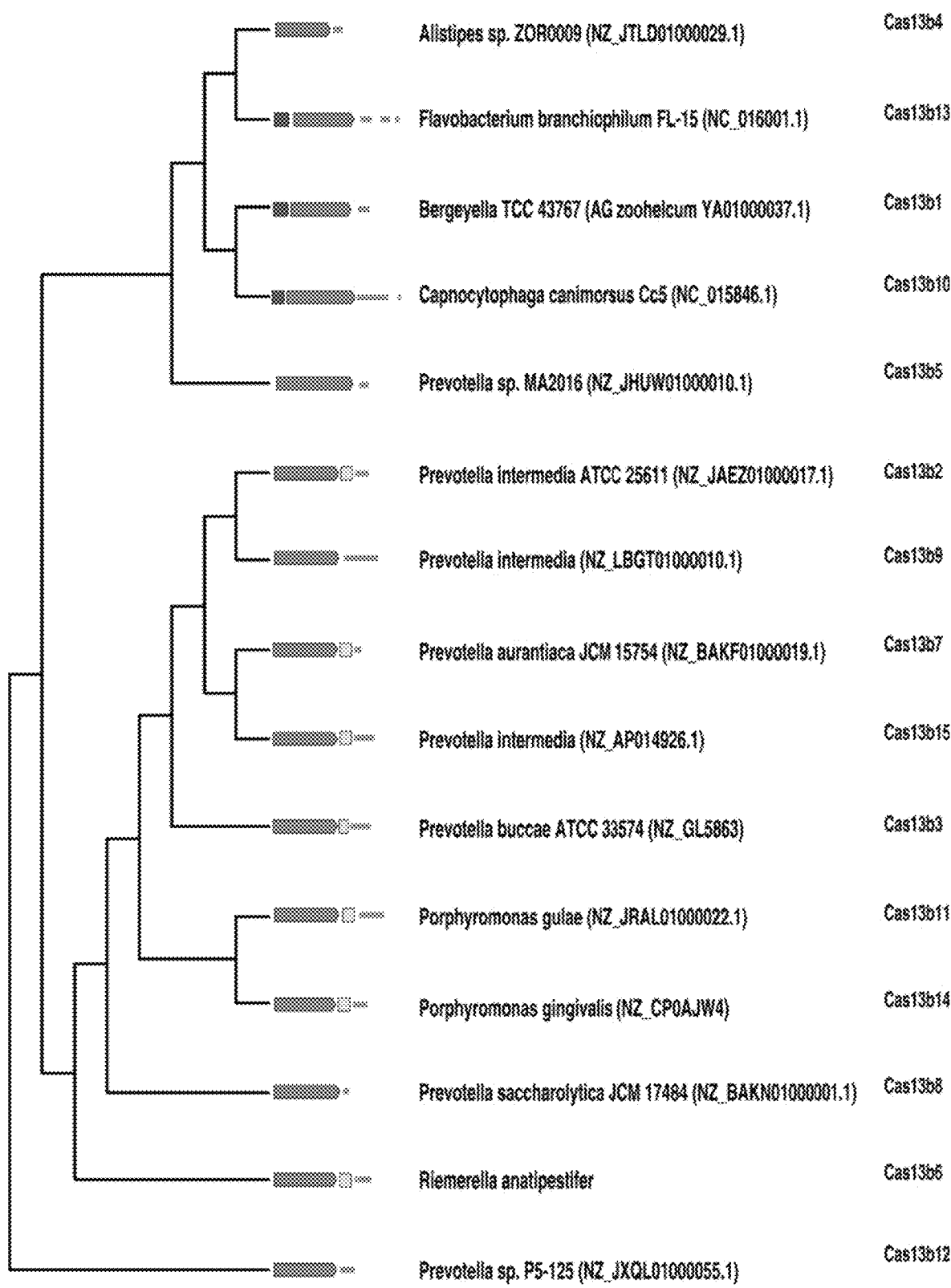
FIG. 85—provides a tree of 15 Cas13b orthologs purified and evaluated for in vitro collateral activity. Cas13b gene (blue), Csx27/Csx28 gene (red/yellow), and CRISPR array (grey) are shown.
Figure 87A:
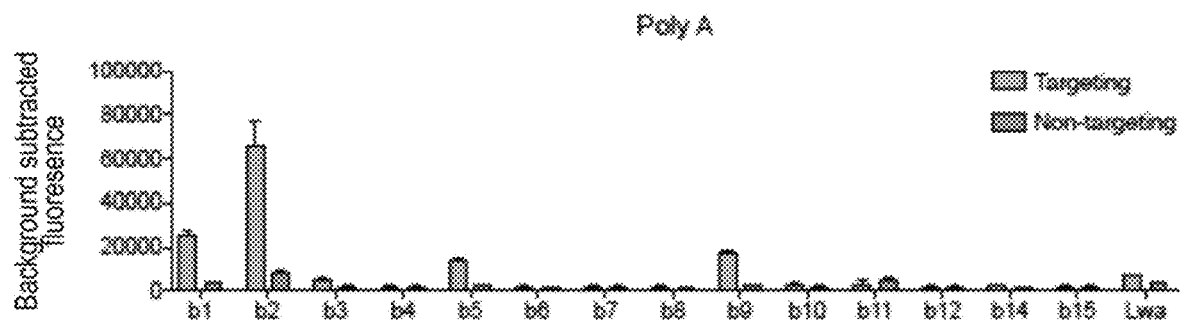
FIGS. 87A-87D show graphs illustrating base preference of Cas13b ortholog collateral cleavage.
Figure 87B:
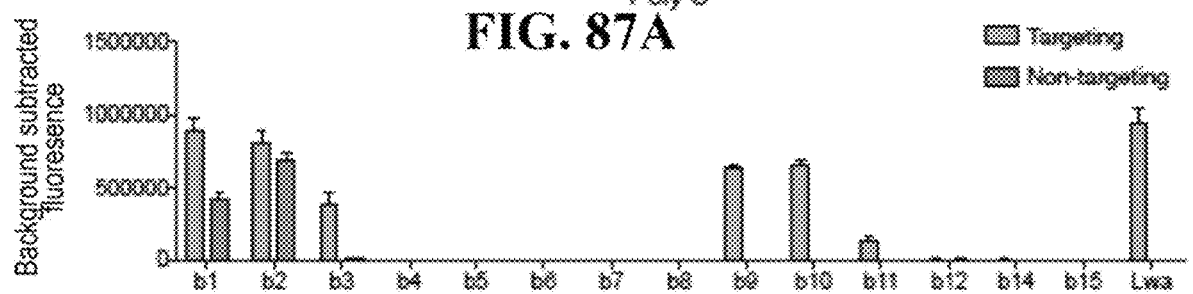
Figure 87C:
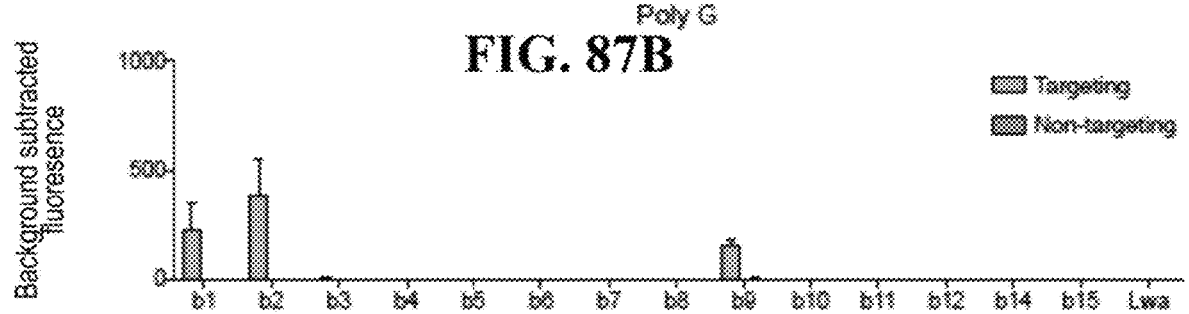
Figure 87D:
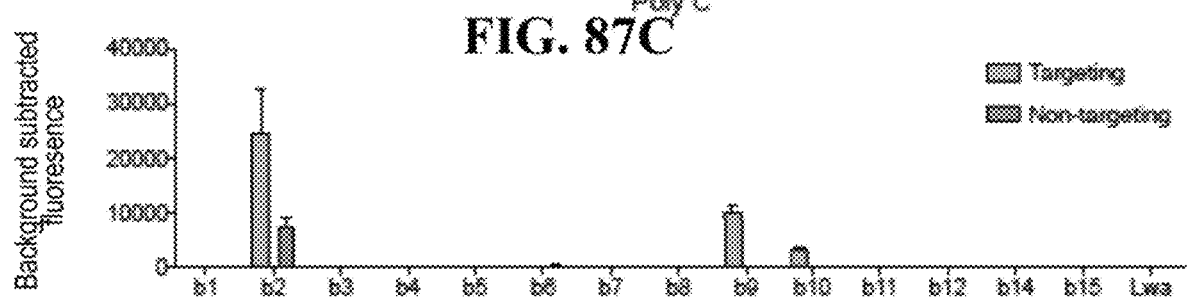

Applicant biochemically characterized fourteen orthologs of the recently defined type VI CRISPR-Cas13b family of RNA-guided RNA-targeting enzymes to find new candidates for improving the SHERLOCK detection technology (FIGS. 83A and 85). Applicant was able to heterologously express fourteen Cas13b orthologs in E. coli and purify the proteins for an in vitro RNase activity assay (FIGS. 86A-86C). Because different Cas13 orthologs might have varying base preferences for optimal cleavage activity, Applicant generated fluorescent RNase homopolymer sensors that consisted of either 5 As, Gs, Cs, or Us to evaluate orthogonal cleavage preferences. Applicant incubated each ortholog with its cognate crRNA targeting a synthetic 173 nt ssRNA 1 and measured collateral cleavage activity using the homopolymer fluorescent sensors (FIGS. 83B and 87A-87D).

Example 4—Motif Discovery Screen with Library

Figure 83C:
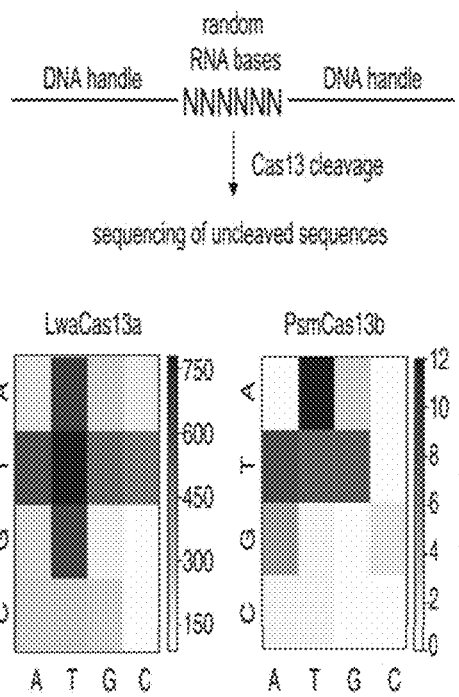
Figure 88:
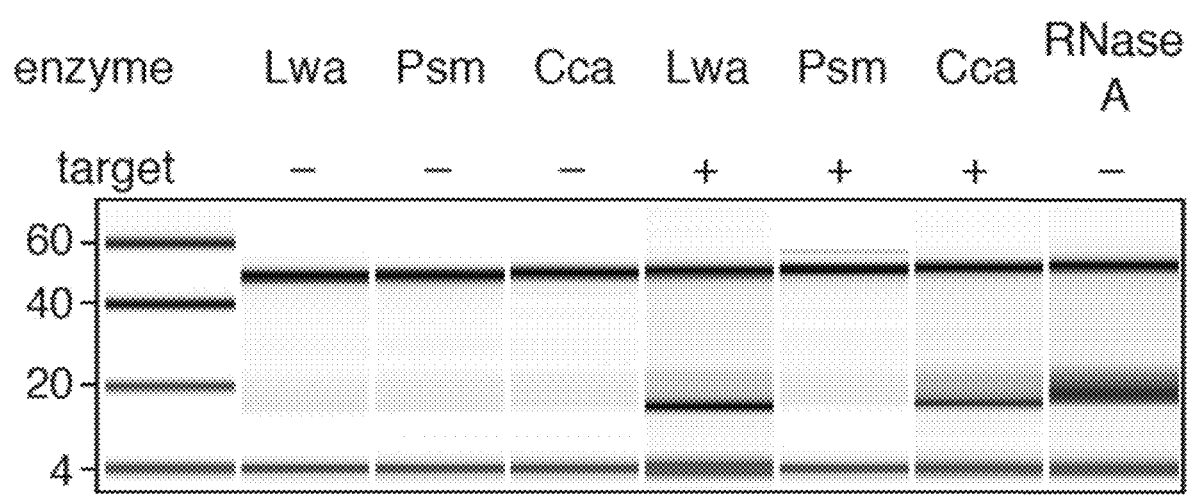
FIG. 88—shows size analysis of random motif-library after Cas13 collateral cleavage. Bioanalyzer traces for LwaCas13a-, PsmCas13b-, CcaCas13b-, and RNase A-treated library samples showing changes in library size after RNase activity. Cas13 orthologs are targeting Dengue ssRNA and cleave the random motif-library due to collateral cleavage. Marker standards are shown in the first lane.

To further explore the diversity of cleavage preferences of the various Cas13a and Cas13b orthologs, Applicant developed a library-based approach for characterizing motifs preferred for endonuclease activity in response to collateral activity. Applicant used a degenerate 6-mer RNA reporter flanked by constant DNA handles, which allowed for amplification and readout of uncleaved sequences (FIG. 83C). Incubating this library with collateral activated Cas13 enzymes resulted in detectable cleavage and depended on the addition of target RNA (FIG. 88). Sequencing of depleted motifs revealed an increase in the skew of the library over digestion time (FIG. 89A), indicative of base-preference, and selecting sequences above a threshold ratio produced number enriched sequences that corresponded with cleavage of the enzymes (FIG. 89B). Sequence logos from enriched motifs reproduced the U-preference observed for LwaCas13a and CcaCas13b and the A-preference of PsmCas13b (FIGS. 89C-89E). Applicant also determined multiple sequences that showed cleavage for only one ortholog, but not others, to allow for independent readout (FIG. 89F).

Figure 90A:
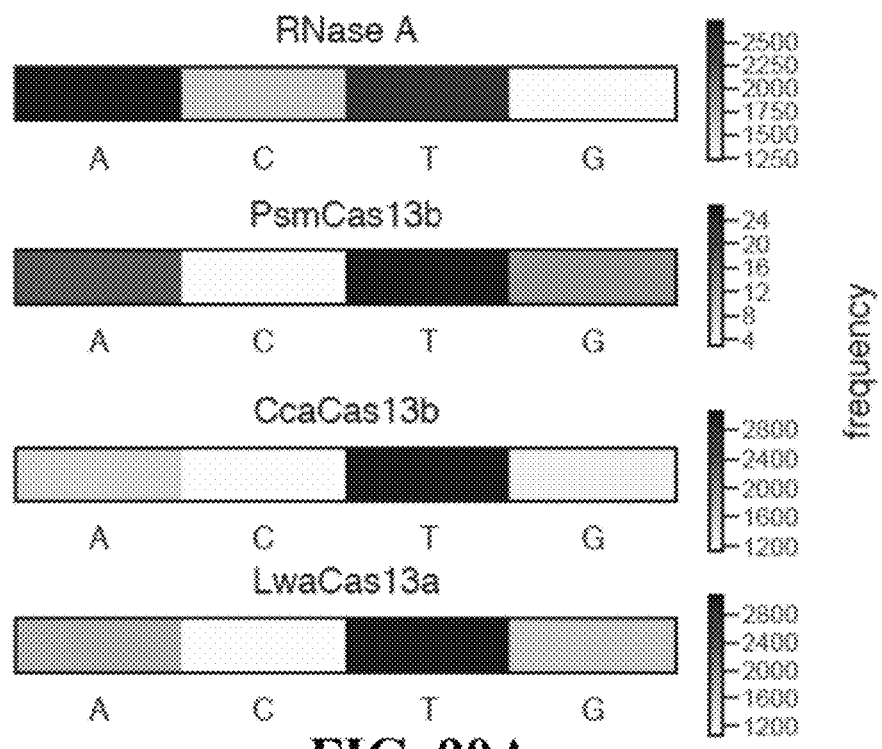
FIGS. 90A-90C show single-base and two-base preferences of RNases determined by random motif library screen.
Figure 90B:
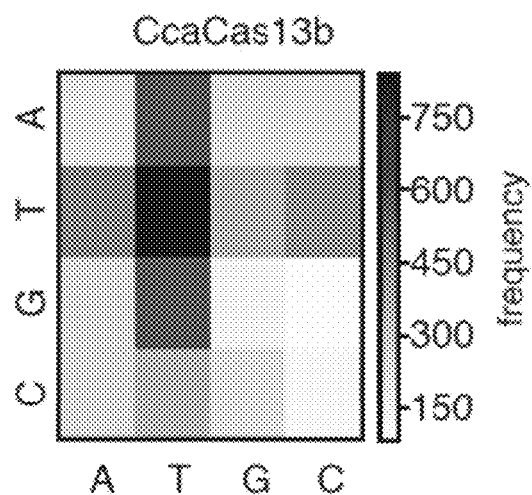

To understand the specific sub-motifs of enzyme preference, Applicant analyzed the depleted motifs for single-base preferences (FIG. 90A), which agreed with homopolymer motifs tested as well as for two-base motifs (FIGS. 83C and 90B). These two base motifs reveal a more complex preference, especially for LwaCas13a and PsmCas13b, which prefers TA, GA, and AT dibase sequences. Higher order motifs also revealed additional preferences (FIGS. 91 and 92A-92D).

Figure 83D:
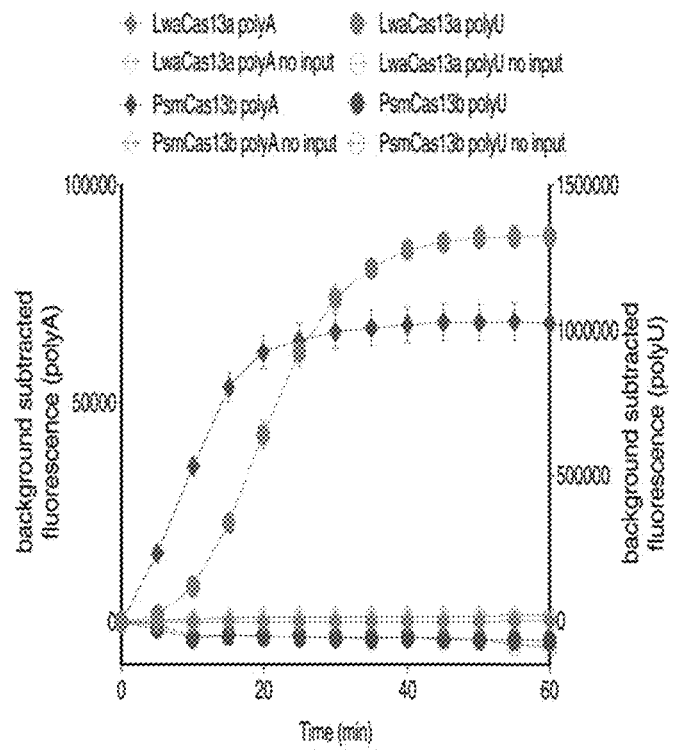
Figure 94B:
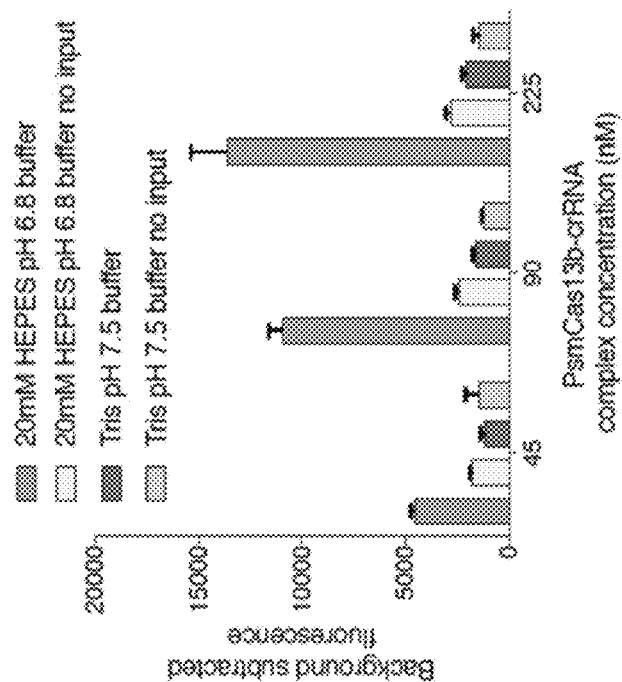
FIGS. 94A and 94B show graphs of results of buffer optimization of PsmCas13b cleavage activity.
Figure 94A:
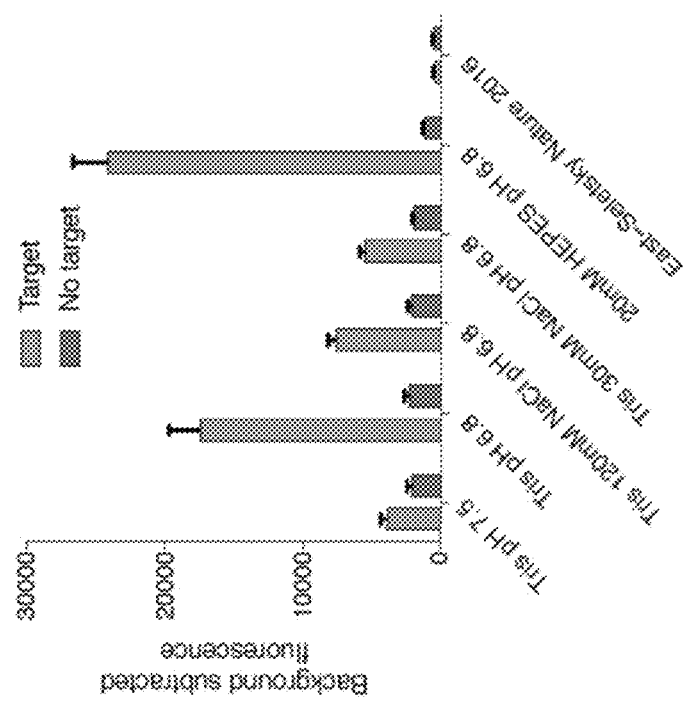
Figure 95A:
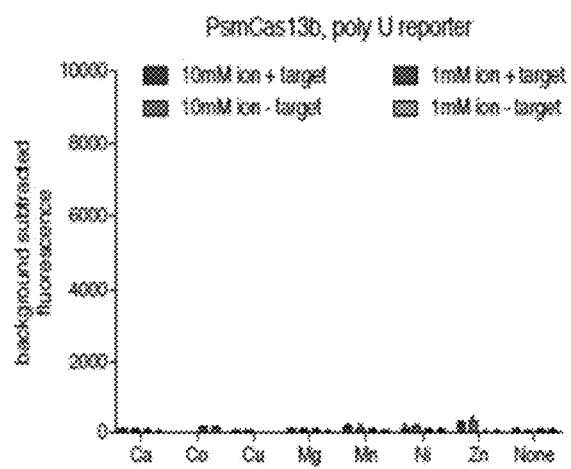
FIGS. 95A-95F are graphs illustrating ion preference of Cas13 orthologs for collateral cleavage.
Figure 95B:
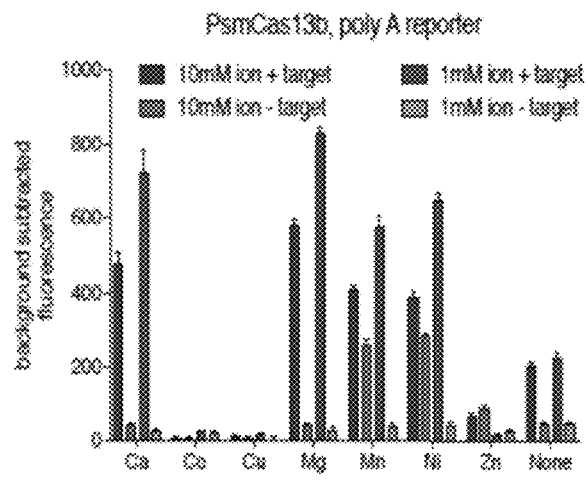
Figure 95C:
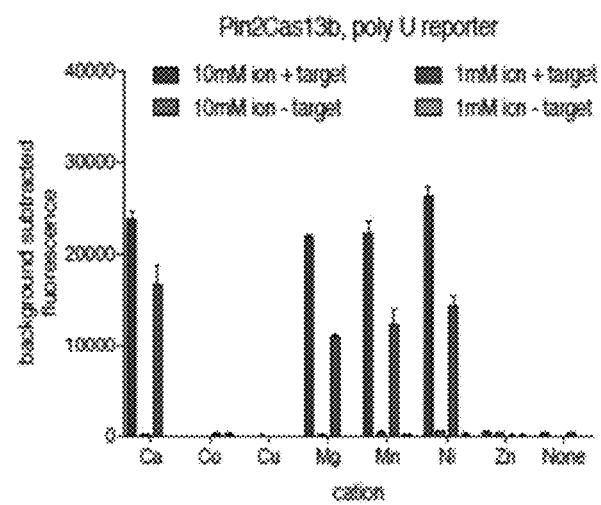
Figure 95D:
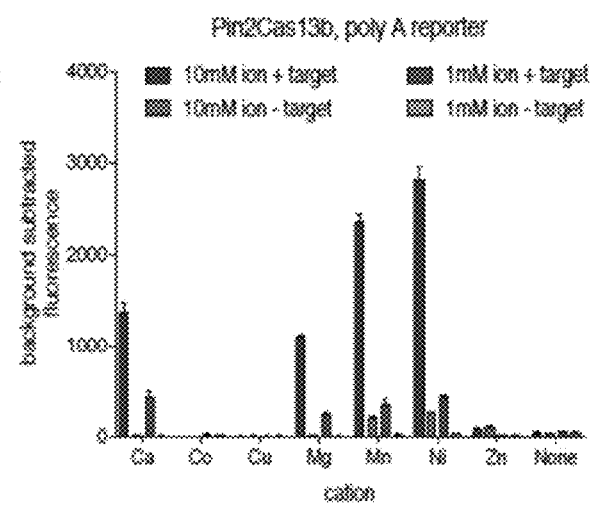
Figure 95E:
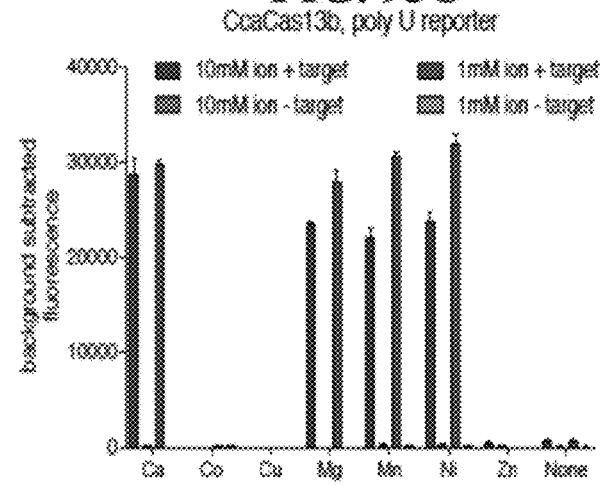
Figure 95F:
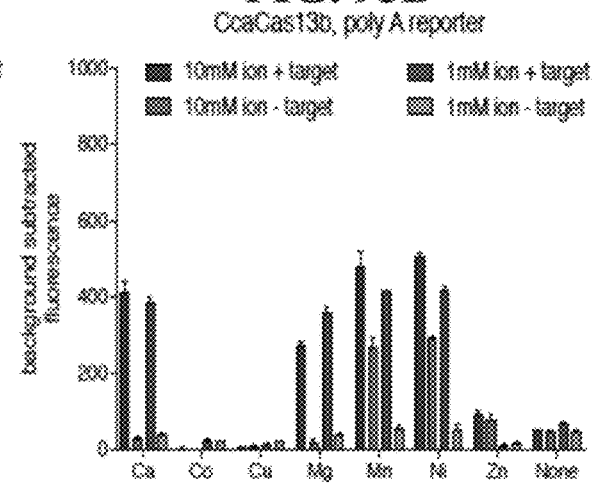
Figure 96A:
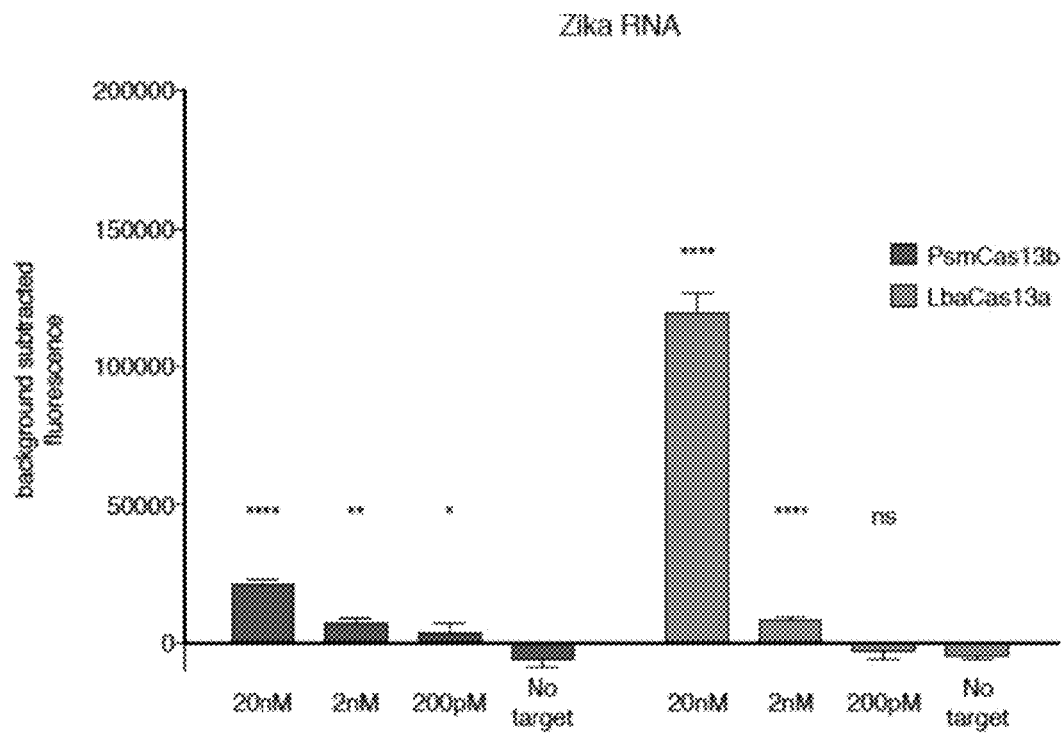
FIGS. 96A and 96B are graphs showing comparison of cleavage activity for Cas13 orthologs with adenine cleavage preference.
Figure 96B:
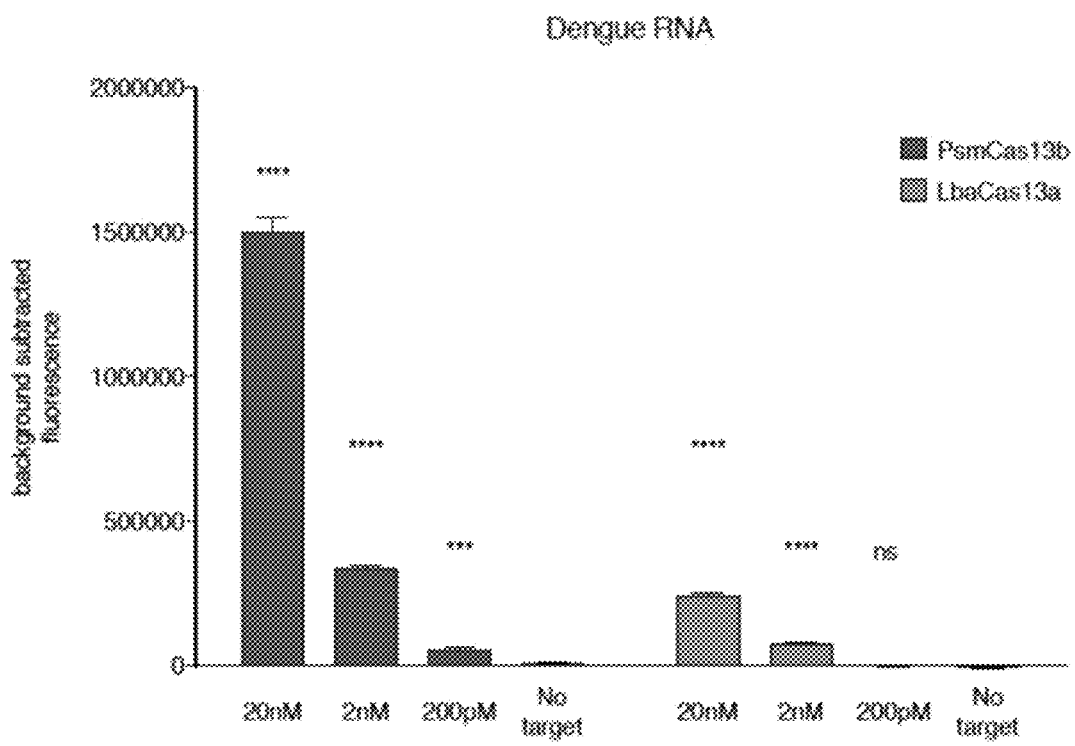
Figure 97A:
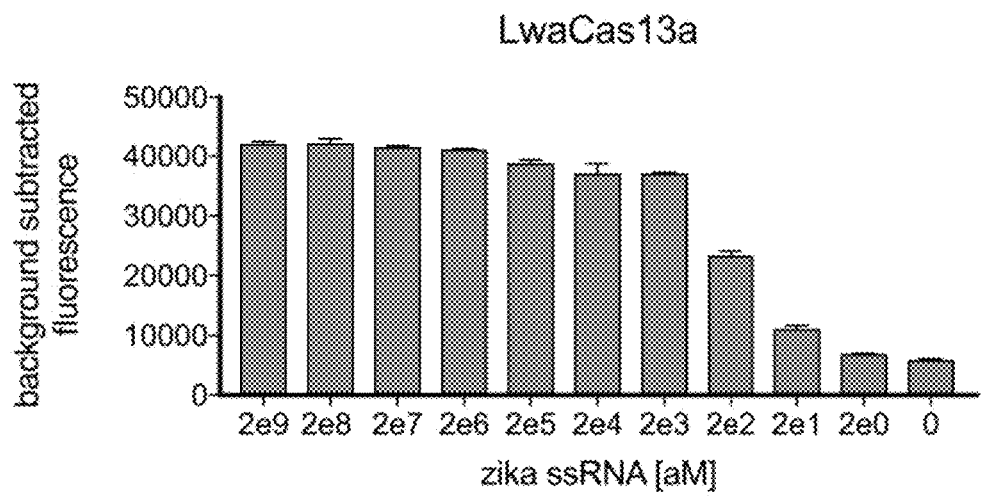
FIGS. 97A and 97B are graphs illustrating attomolar detection of Zika ssRNA target 4 with SHERLOCK with LwaCas13a and PsmCas13b.
Figure 97B:
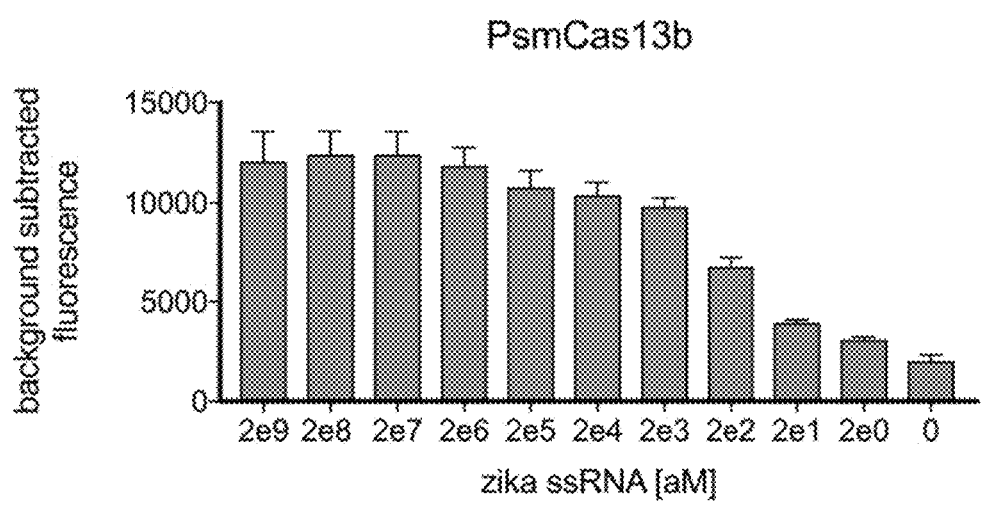
Figure 98:
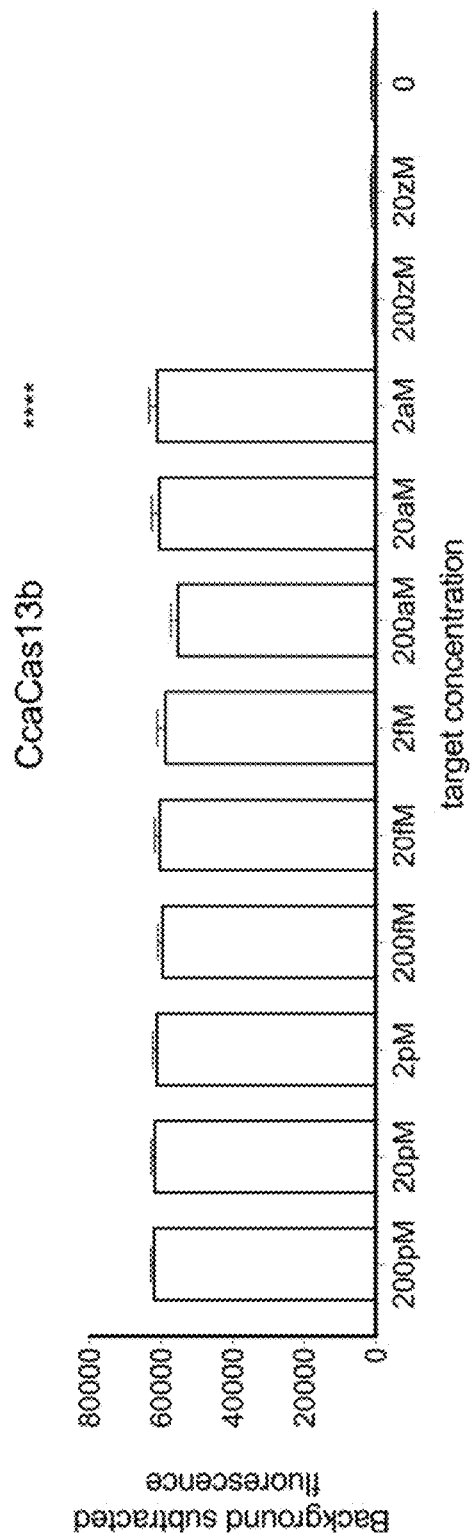
FIG. 98—illustrates attomolar detection of Dengue ssRNA with SHERLOCK at different concentrations of CcaCas13b.

Applicant confirmed the collateral preferences of LwaCas13a, PsmCas13b, and CcaCas13b with in vitro digestion of targets (FIGS. 93A-93C). In order to improve the weak digestion of PsmCas13b, Applicant optimized the buffer composition and enzyme concentration (FIGS. 94A, 94B). Other dications tested on PsmCas13b and Cas13b orthologs did not have large effects (FIGS. 95A-95F). Applicant also compared PsmCas13b to a previously characterized A-preference Cas13 family member for two RNA targets, and found comparable or improved sensitivity (FIGS. 96A, 96B). From these results, Applicant compared kinetics of LwaCas13a and PsmCas13b, in separate reactions with independent reporters, and found low levels of cross-talk between the two channels (FIG. 83D).

Example 5—Single Molecule Detection with LwaCas13A, PsmCas13b, and CcaCas13b

Figure 99B:
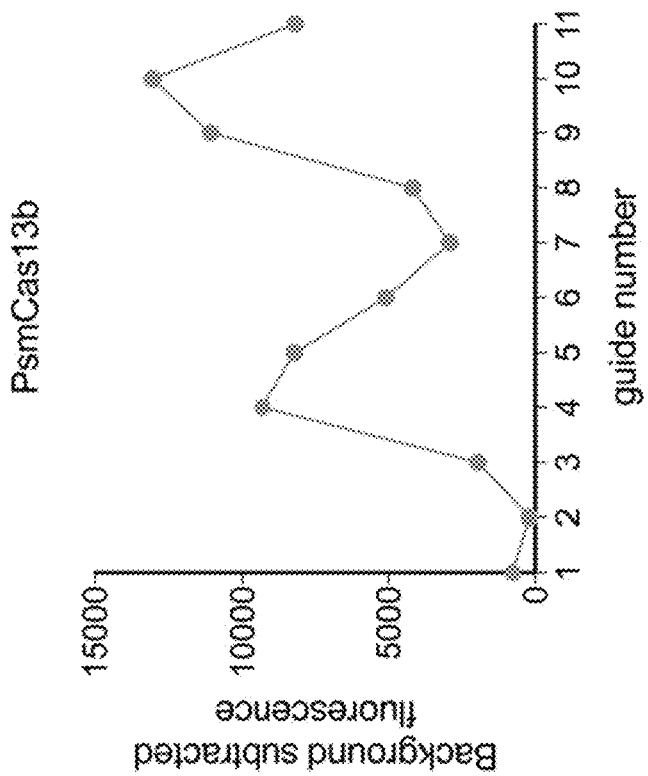
FIGS. 99A and 99B are graphs showing results from testing Cas13 ortholog reprogrammability with crRNAs tiling ssRNA 1.
Figure 99A:
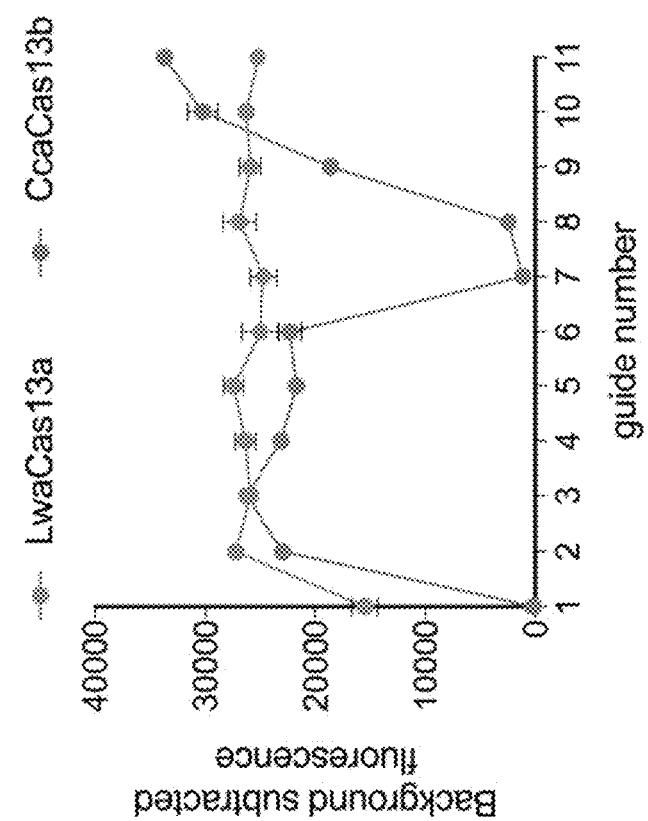
Figure 100A:
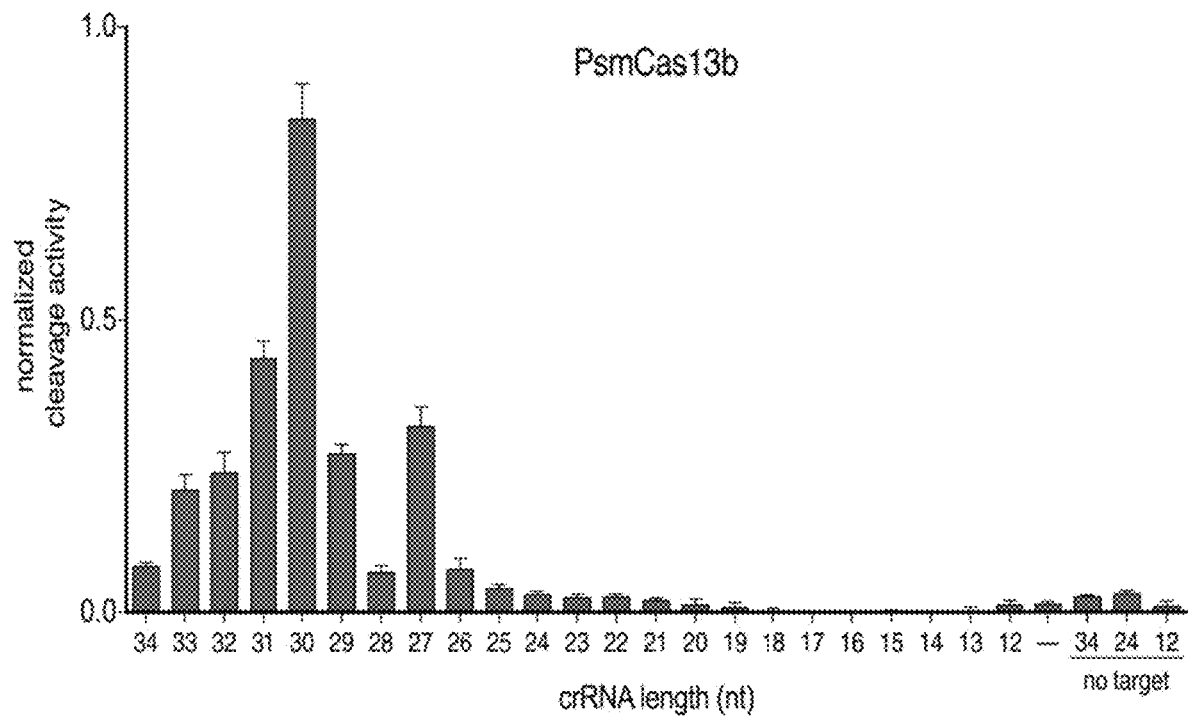
FIGS. 100A and 100B are graphs showing the effect of crRNA spacer length on Cas13 ortholog cleavage.
Figure 100B:
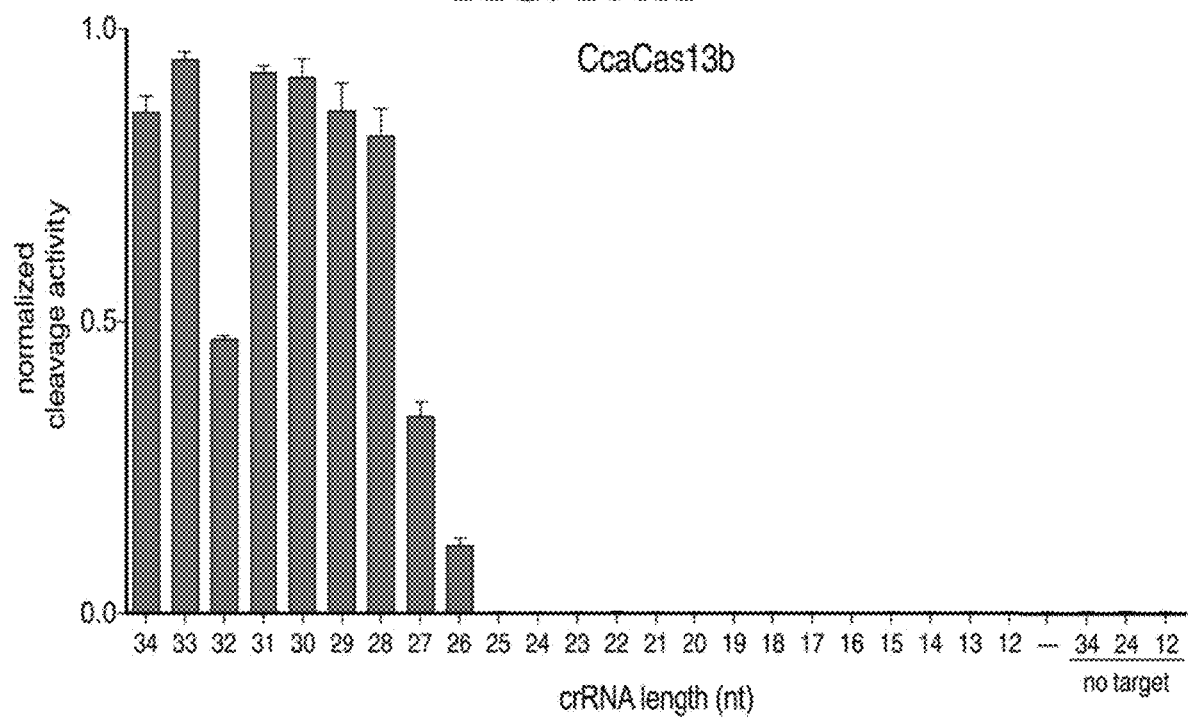

A key feature of the SHERLOCK technology is that it enables single molecule detection (2 aM or 1molecule/μL) by LwaCas13a collateral RNase activity. To characterize the sensitivity of Cas13b enzymes, Applicant performed SHERLOCK with PsmCas13b and CcaCas13b, another highly active Cas13b enzyme with uridine preference (FIG. 83E). Applicant found that LwaCas13a, PsmCas13b, and CcaCas13b were capable of achieving 2 aM detection of two different RNA targets, ssRNA 1 and a synthetic Zika ssRNA (FIGS. 83E; 97A, 97B, and 98). To investigate the robustness of targeting with these three enzymes, Applicant designed eleven different crRNAs evenly spaced across ssRNA 1 and found that LwaCas13a most consistently achieved signal detection, while CcaCas13b and Psmcas13b both showed much more variability in detection from crRNA to crRNA (FIGS. 99A, 99B). To identify the optimal crRNA for detection, Applicant varied the spacer length of PsmCas13b and CcaCas13b from 34-12 nt and found that PsmCas13b had a peak sensitivity at a spacer length of 30 while CcaCas13b had equivalent sensitivity above spacer lengths of 28 nt (FIGS. 100A, 100B). Applicant also tested if the detection limit could be pushed beyond 2 aM, allowing for larger sample volume inputs into SHERLOCK. By scaling up the pre-amplification RPA step, Applicant found that both LwaCas13a and PsmCas13b could give significant detection signals for 200, 20, and 2zM input samples and allow for volume inputs of 250 μL and 540 μL.

Example 6—Quantitative Sherlock with RPA

Figure 101A:
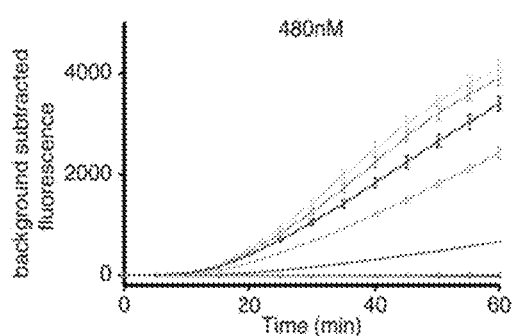
FIGS. 101A-101G illustrate optimizing primer concentration for quantitative SHERLOCK.
Figure 101B:
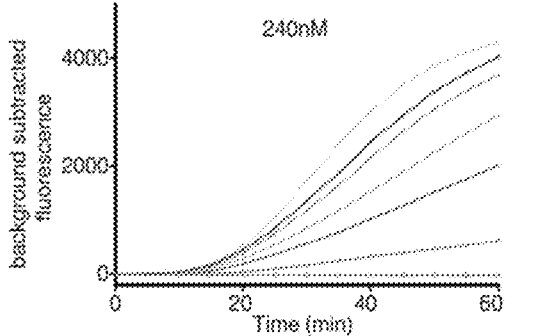
Figure 101C:
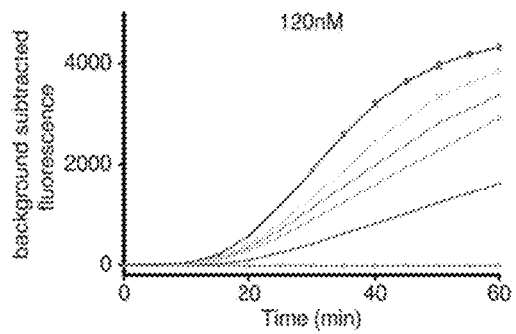
Figure 101D:
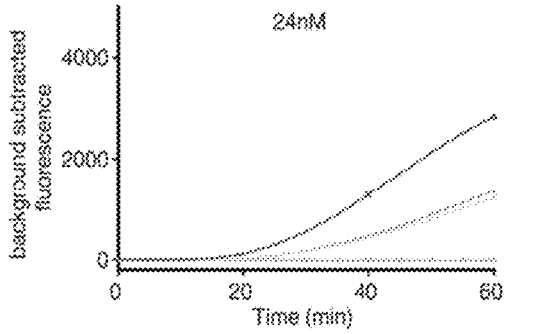
Figure 101E:
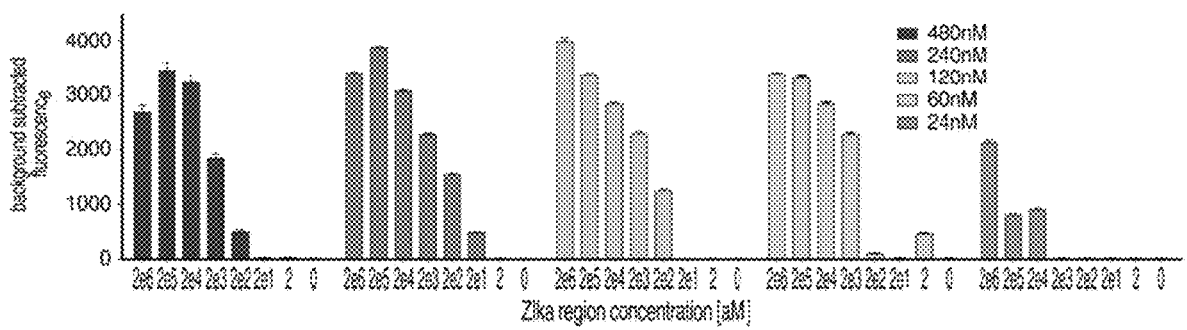
Figure 101F:
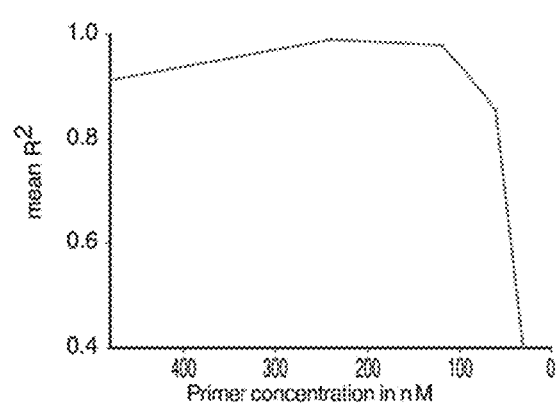
Figure 101G:
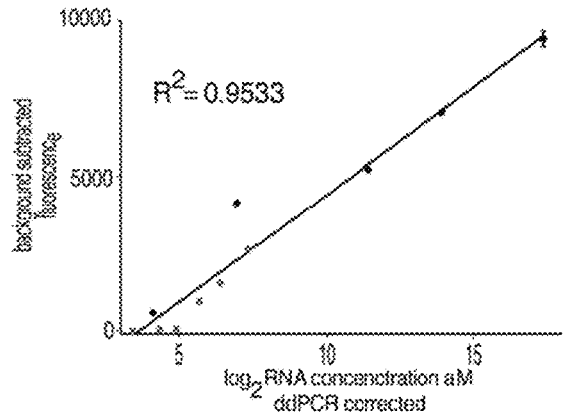

As SHERLOCK relies on an exponential amplification, accurate quantitation of nucleic acids can be difficult. Applicant hypothesized that reducing the efficiency of the RPA step could improve the correlation between the input amount and the signal of the SHERLOCK reaction. Applicant observed that the kinetics of the SHERLOCK detection were very sensitive to primer concentration across a range of sample concentrations (FIGS. 101A-101D). Applicant diluted primer concentrations, which increased both signal and quantitative accuracy (FIGS. 83G and 101E). This observation may be due to a decrease in primer-dimer formation, allowing for more effective amplification while preventing saturation. Primer concentrations of 120 nM exhibited the greatest correlation between signal and input (FIG. 101F). This accuracy was sustainable across a large range of concentrations down to the attomolar range (FIGS. 83H and 101G).

Example 7—Two Color Multiplexing with Orthogonal Cas13 Orthologs

Figure 102A:
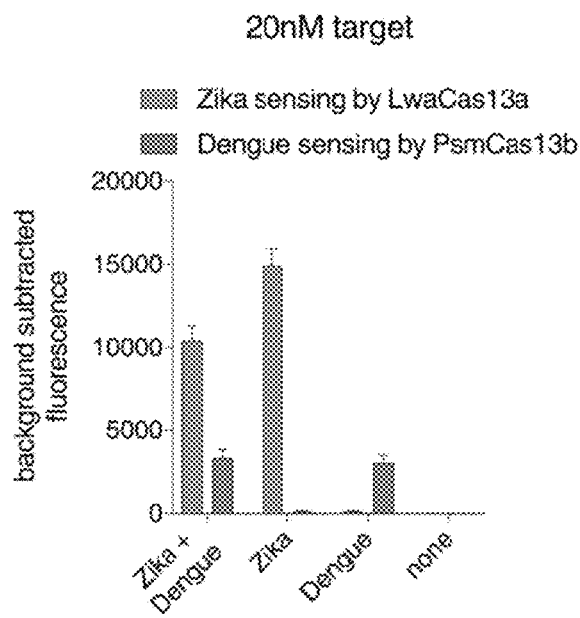
FIGS. 102A-102C illustrate multiplexed detection of Zika and Dengue targets.
Figure 102B:
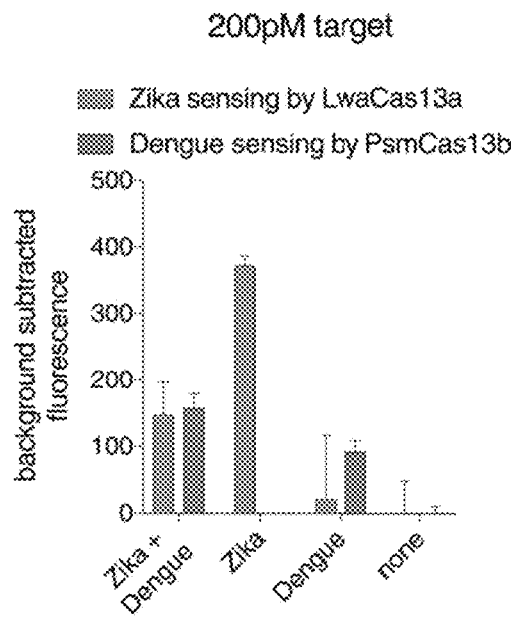
Figure 102C:
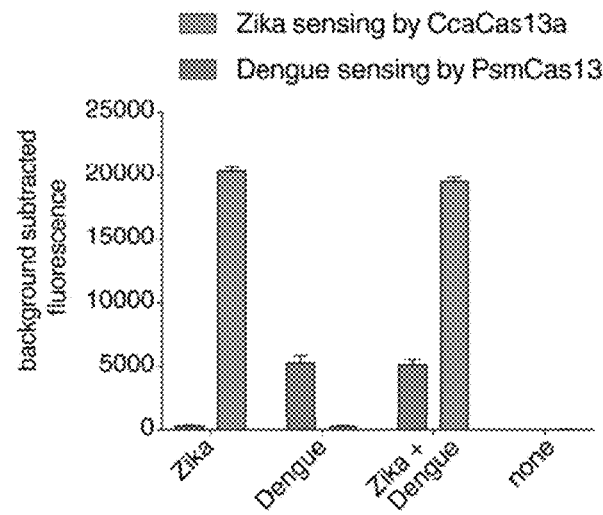
Figure 103B:
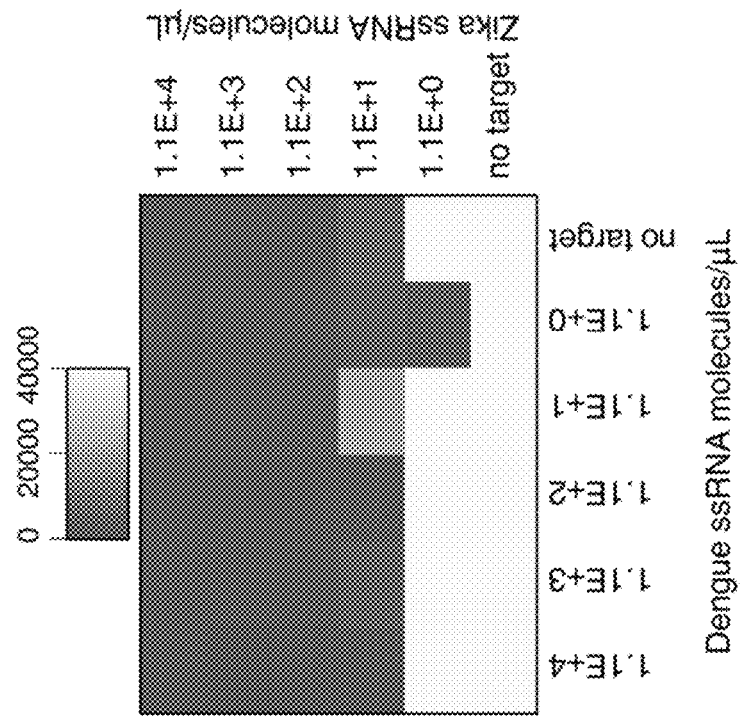
FIGS. 103A and 103B are heatmaps illustrating in-sample multiplexed RNA detection of (FIG. 103B) Zika and (FIG. 103A) Dengue ssRNA. In-sample multiplexed RPA and collateral detection at decreasing concentrations of Zika and Dengue synthetic targets with PsmCas13b and CcaCas13b.
Figure 103A:
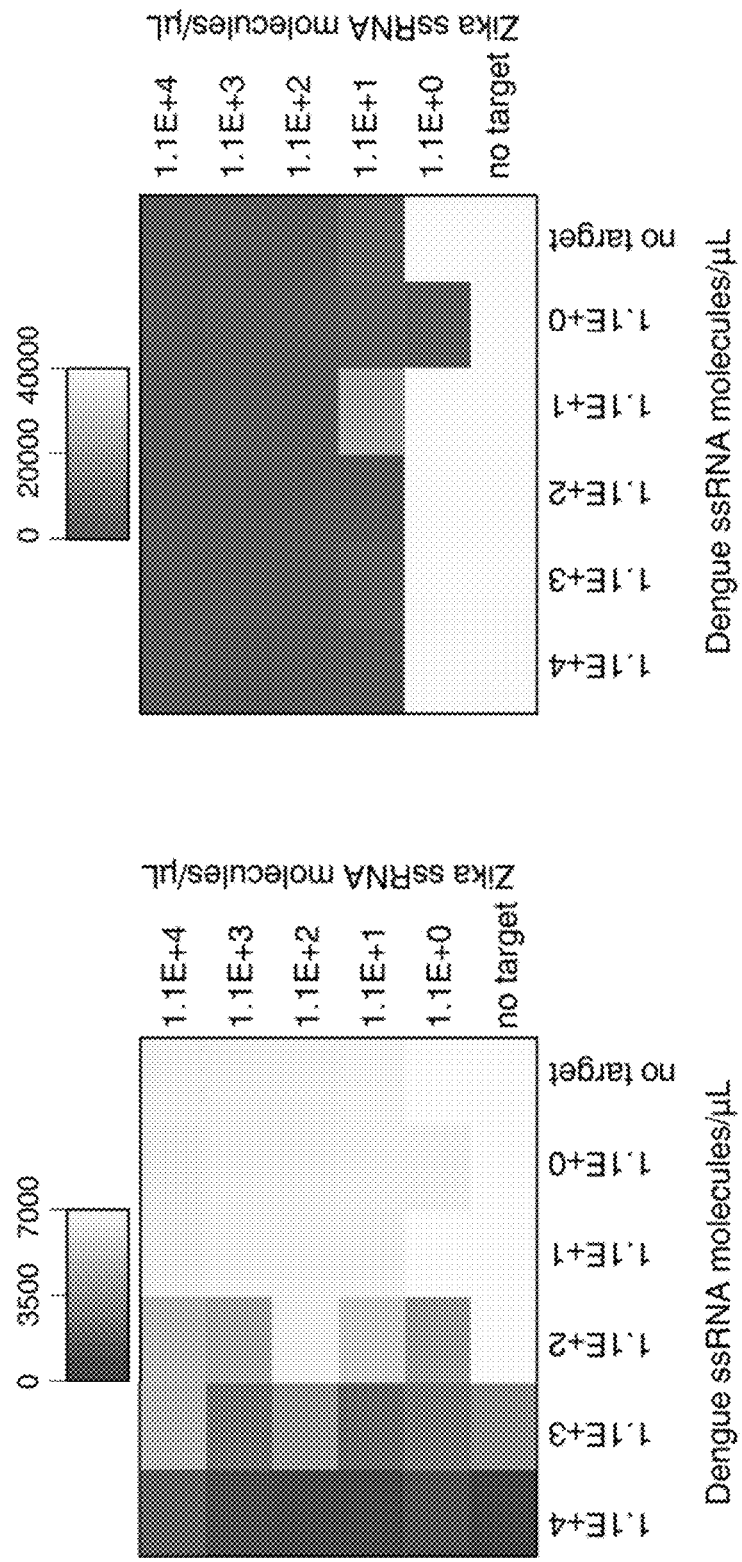

An advantageous feature of nucleic acid diagnostics is the ability to simultaneously detect multiple sample inputs, allowing for multiplexed detection panels or for in sample controls. Orthogonal base preferences of the Cas13 enzymes offer the opportunity to have multiplexed SHERLOCK. Applicant can assay the collateral activity of different Cas13 enzymes in the same reaction via fluorescent homopolymer sensors of different base identities and fluorophore colors, enabling multiple targets to be simultaneously measured (FIG. 84A). To demonstrate this concept, Applicant designed an LwaCas13a crRNA against the Zika virus ssRNA and a PsmCas13b crRNA against the Dengue virus ssRNA. Applicant found that this assay with both sets of Cas13-crRNA complexes in the same reaction, was capable of identifying if Zika or Dengue RNA, or both, were present in the reaction (FIG. 84B). Applicant also found that because of the orthogonal preferences between CcaCas13b and PsmCas13b, that these two enzymes could also be leveraged for multiplexed detection of Zika and Dengue targets (FIGS. 102A-102C). Applicant was successfully able to extend this concept towards the entire SHERLOCK reaction, containing both multiplexed RPA primers and Cas13-crRNA complexes. Applicant designed an LwaCas13a crRNA against P. aeruginosa and a PsmCas13b crRNA against S. aureus and were able to detect both DNA targets down to the attomolar range (FIG. 84C). Similarly, using both PsmCas13b and LwaCas13a Applicant was able to achieve attomolar multiplexed detection of Zika and Dengue RNA using SHERLOCK (FIGS. 103A, 103B).

Applicant has shown that LwaCas13a enabled single nucleotide variant detection and that this could be applied for rapid genotyping from human saliva, but detection required two separate reactions: one for each allele-sensing crRNA. To enable a single-reaction SHERLOCK genotyping, Applicant designed a LwaCas13a crRNA against the G-allele and a PsmCas13b crRNA against the A-allele of the rs601338 SNP, a variant in the alpha(1,2)-fucosyltransferase FUT2 gene that associates with norovirus resistance. Using this single-sample multiplexed approach, Applicant was able to successfully genotype four different human subjects using their saliva and accurately identify whether they were homozygous or heterozygous.

Figures 104A, 104B:
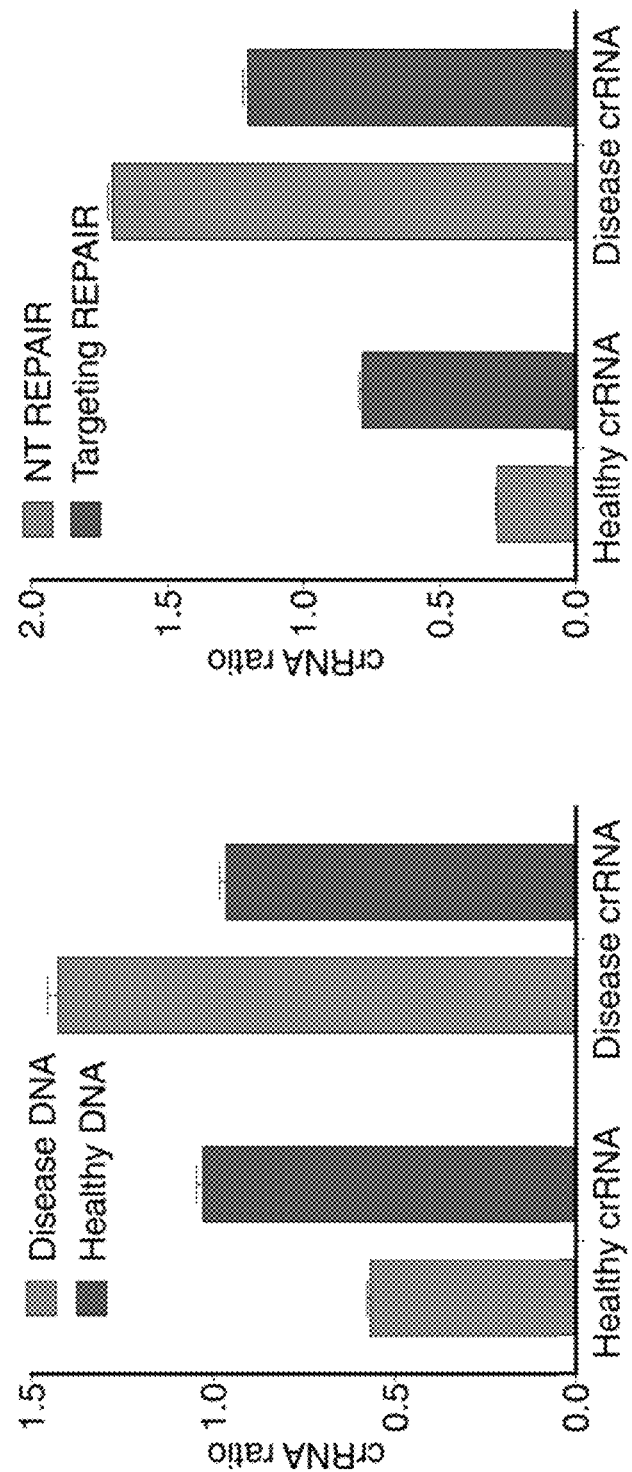
FIGS. 104A and 104B are graphs illustrating non-multiplexed theranostic detection of mutations and REPAIR editing.
Figure 105A:
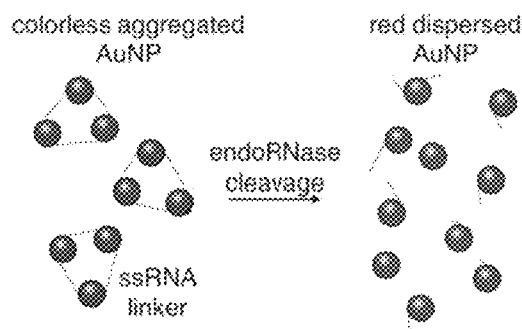
FIGS. 105A-105E illustrate colorimetric detection of RNase activity with gold nanoparticle aggregation.
Figure 105B:
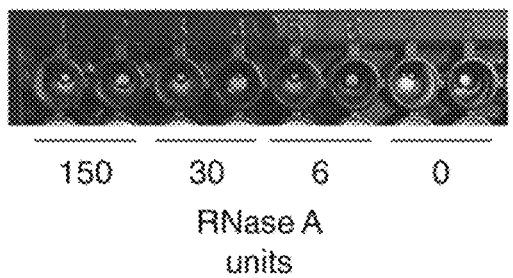
Figure 105C:
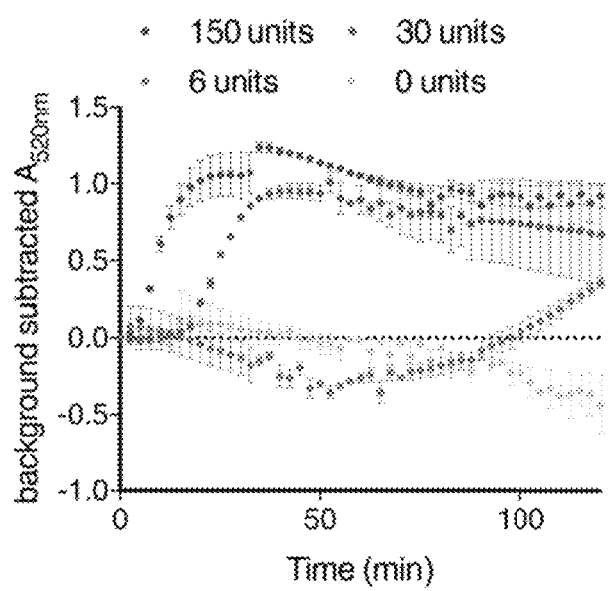
Figure 105D:
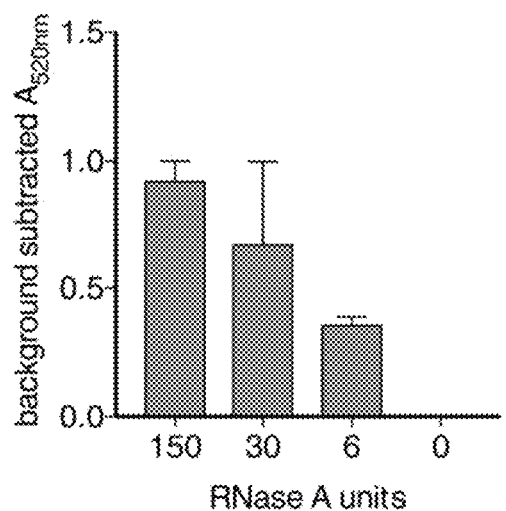
Figure 105E:
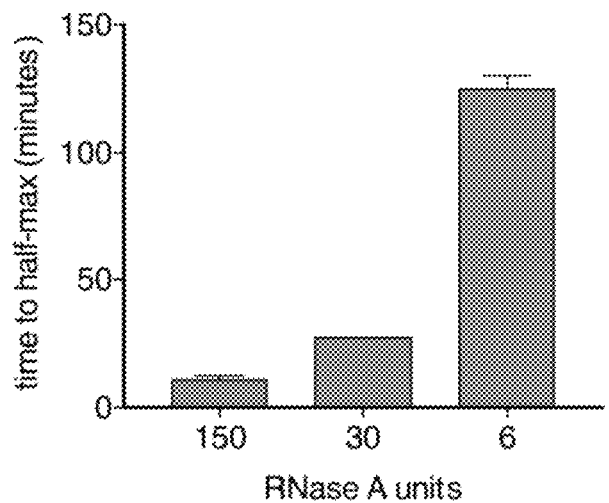

To further showcase the versatility of the Cas13 family of enzymes, Applicant simulated a therapeutic approach that involves Cas13 serving as both a companion diagnostic and the therapy itself. Applicant recently developed PspCas13b for programmable RNA editing of transcripts, which can be used for correction mutations in genetic diseases, using a system called RNA Editing for Programmable A to I Replacement (REPAIR). Because diagnostics can be very useful when paired with therapies to guide treatment decisions or to monitor the outcome of a treatment, Applicant thought that SHERLOCK could be used for genotyping to guide the REPAIR treatment and also as a readout on the edited RNA to track the editing efficiency of the therapy (FIG. 84F). Applicant chose to demonstrate this theranostic concept to correct an APC mutation (APC:c.1262G>A) in Familial adenomatous polyposis 1, an inherited disorder that involves cancer in the large intestine and rectum. Applicant designed healthy and mutant cDNAs of the APC gene and transfected these into HEK293FT cells. Applicant was able to harvest the DNA from these cells and successfully genotype the correct samples using single-sample multiplexed SHERLOCK with LwaCas13a and PsmCas13b (FIG. 84G). Concurrently, Applicant designed and cloned guide RNAs for the REPAIR system and transfected cells that had the diseased genotype with the guide RNA and dPspCas13b-ADAR2dd(E488Q) REPAIR system. After 48 hours, Applicant harvested RNA, which Applicant split for input into SHERLOCK to detect the editing outcome and for next-generation sequencing (NGS) analysis to confirm the editing rate. Sequencing revealed that Applicant achieved 43% editing with the REPAIR system (FIG. 84G) and was able to detect this with SHERLOCK as the healthy-sensing crRNA showed higher signal than the non-targeting guide control condition and the disease-sensing crRNA showed a decrease in signal (FIGS. 84H and 104A-104B). Overall the design and synthesis of reagents for this assay took 3 days, the genotyping took 1 day, and the correction with REPAIR and sensing the editing rate took 3 days, yielding a total theranostics pipeline that lasts only 7 days.

Applicant has demonstrated the highly sensitive and specific detection of nucleic acids using the type VI RNA-guided RNA-targeting CRISPR-Cas13a ortholog from *Leptotrichia wadei*. Applicant has further shown that the Cas13b family of enzymes are active biochemically and have unique properties that make them amenable for multiplexed detection of nucleic acids by SHERLOCK. By characterizing the orthogonal base preferences of the Cas13b enzymes, Applicant found specific sequences of fluorescent RNA sensors that are recognized by PsmCas13b that LwaCas13a does not recognize. Applicant was able to leverage these base preferences to make in-sample multiplexed detection of two different targets possible and show the utility of this feature for distinguishing viral strains and genotyping individuals. Additionally, through engineering of the pre-amplification step, SHERLOCK can be made quantitative, allowing for approximation of the input nucleic acid concentration or quantitation. Applicant has additionally shown that the orthogonal PsmCas13b is capable of single molecule detection and that through scaling up the volume Applicant can perform detection of samples up to ~0.5 mL and down to concentrations of 2zM.

Figure 90C:
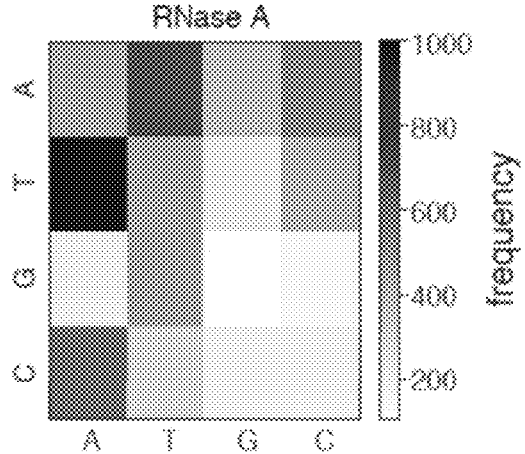
Figure 91:
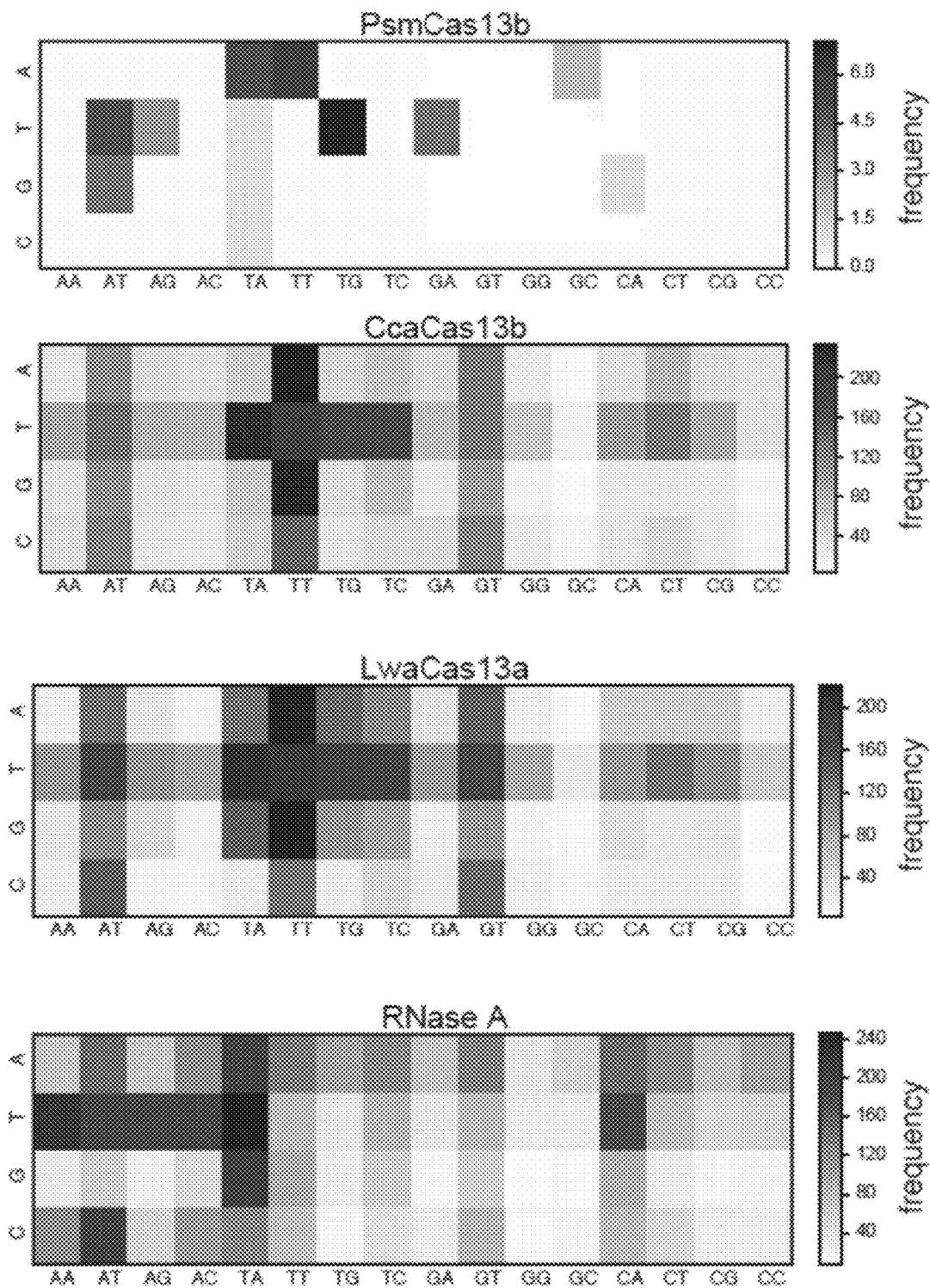
FIG. 91—illustrates three-base preferences of RNases determined by random motif library screen. Heatmaps show three-base preferences for LwaCas13a, PsmCas13b, CcaCas13b, and RNase A at the 60 minute timepoint as determined by the random motif library cleavage screen. Values represented in the heatmap are the counts of each 3-base across all depleted motifs. Motifs are considered depleted if the $-\log_2$(target/no target) value is above 1.0 in the LwaCas13a, CcaCas13b, and RNase A conditions or 0.5 in the PsmCas13b condition. In the $-\log_2$(target/no target) value, target and no target denote the frequency of a motif in the target and no target conditions, respectively.
Figure 92A:
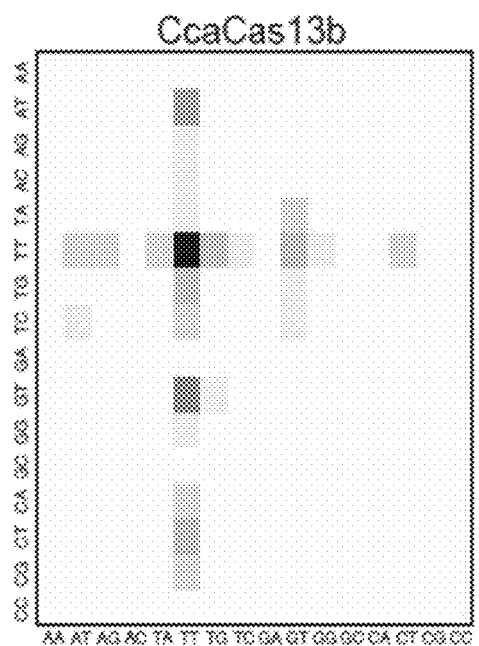
FIGS. 92A-92D illustrate four-base preferences of RNases determined by random motif library screen. Heatmaps show four-base preferences for (FIG. 92B) LwaCas13a, (FIG. 92C) PsmCas13b, (FIG. 92A) CcaCas13b, and (FIG. 92D) RNase A at the 60 minute timepoint as determined by the random motif library cleavage screen. Values represented in the heatmap are the counts of each 4-base across all depleted motifs. Motifs are considered depleted if the $-\log_2$(target/no target) value is above 1.0 in the LwaCas13a, CcaCas13b, and RNase A conditions or 0.5 in the PsmCas13b condition. In the $-\log_2$(target/no target) value, target and no target denote the frequency of a motif in the target and no target conditions, respectively.
Figure 92B:
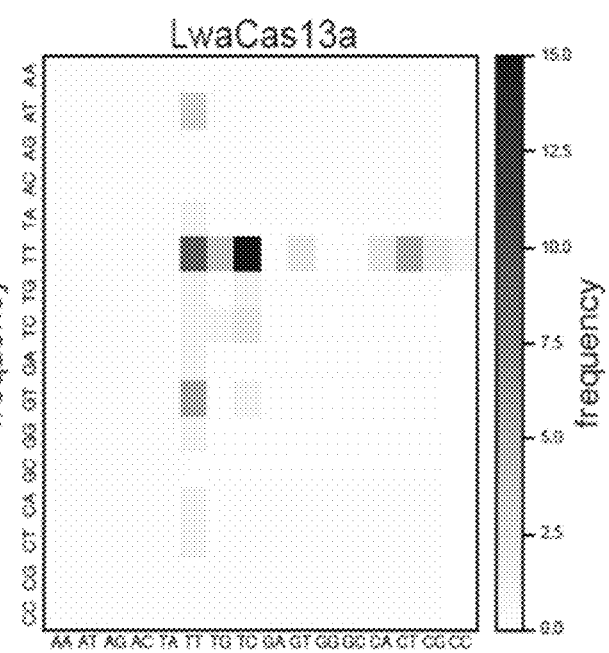
Figure 92C:
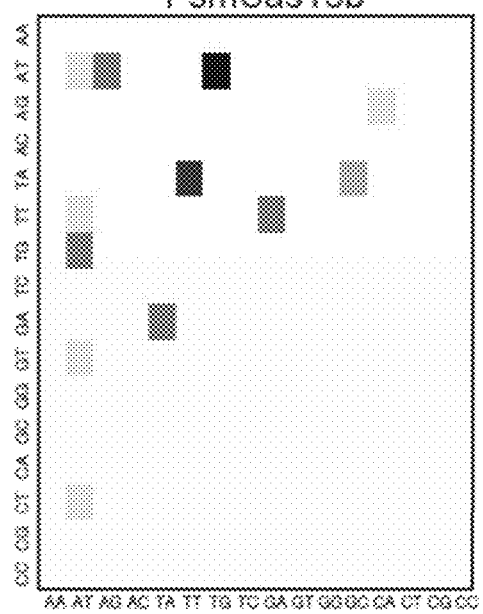
Figure 92D:
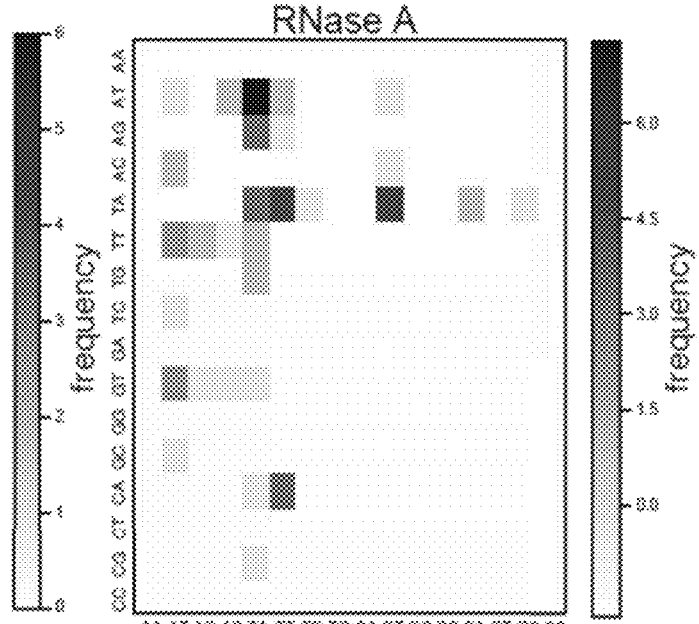

Multiplexed detection with SHERLOCK is possible by spatially performing multiple reactions, but in-sample multiplexing via orthogonal base preferences allows for many targets to be detected at scale and for cheaper cost. While Applicant has shown here two-input multiplexing, the cleavage motif screens enable the design of additional orthogonal cleavage sensors (FIGS. 90A-90C). LwaCas13a and CcaCas13b, which both cleave the same uridine homopolymer and are thus not orthogonal as measured by homopolymer sensors (FIG. 83B), showed very unique cleavage preferences by the motif screens (FIGS. 90A-90C). By screening additional Cas13a, Cas13b, and Cas13c orthologs, it is likely that many orthologs will reveal unique 6-mer motif preferences, which could theoretically allow for highly-multiplexed SHERLOCK limited only by the number of spectrally-unique fluorescent sensors. Highly-multiplexed SHERLOCK enables many technological applications, especially those involving complex input sensing and logical computation.

These additional refinements of Cas13-based detection for visual, more sensitive, and multiplexed readouts enable increased applications for nucleic acid detection, especially in settings where portable and instrument-free analysis are necessary. Rapid multiplexed genotyping can inform pharmacogenomic decisions, test for multiple crop traits in the field, or assess for the presence of co-occurring pathogens. Rapid, isothermal readout increases the accessibility of this detection for settings where power or portable readers are unavailable, even for rare species like circulating DNA. Improved CRISPR-based nucleic acid tests make it easier to understand the presence of nucleic acids in agriculture, pathogen detection, and chronic diseases.

Embodiments of the present invention may be further defined by reference to the following numbered paragraphs.

1. A diagnostic device comprising one or more individual discrete volumes, each individual discrete volume comprising a CRISPR system comprising an effector protein and one or more guide RNAs designed to bind to corresponding target molecules and a masking construct.

2. The diagnostic device of paragraph 1, wherein each individual discrete volume further comprises one or more detection aptamers comprising a masked RNA polymerase promoter binding site or a masked primer binding site.

3. The device of paragraphs 1 or 2, wherein each individual discrete volume further comprises nucleic acid amplification reagents.

4. The device of paragraph 3, wherein the amplification reagents comprise a primer comprising an RNA polymerase promoter.

5. The device of paragraph 3, wherein the target molecule is a target DNA and the individual discrete volumes further comprise a primer that binds the target DNA and comprises a RNA polymerase promoter.

6. The device of any one of paragraphs 1 to 5, wherein the individual discrete volumes are droplets.

7. The device of any one of paragraphs 1 to 5, wherein the individual discrete volumes are defined on a solid substrate.

8. The device of paragraph 7, wherein the individual discrete volumes are microwells.

9. The device of paragraph 7, wherein the individual discrete volumes are spots defined on a substrate.

10. The device of paragraph 9, wherein the substrate is a flexible materials substrate.

11. The device of paragraph 10, wherein the flexible materials substrate is a paper substrate or a flexible polymer based substrate.

12. The device of paragraph 7, wherein the individual discrete volumes are microfluidic channels in a lab-on-chip (LOC) device.

13. The device of paragraph 12, wherein the LOC is a Radio frequency identification (RFID) tag system.

14. The device of paragraph 13, further comprising a wireless device configured to communicate with the RFID system.

15. The device of any of paragraphs 7 to 14, wherein the CRISPR effector protein is bound to each discrete volume.

16. The device of paragraph 15, wherein the effector protein is a fusion protein comprising an affinity tag.

17. The device of paragraph 16, wherein the effector protein is linked to a biotin molecule and the discrete volumes comprise streptavidin.

18. The device of any one of paragraphs 1 to 17, wherein the RNA targeting effector protein is a CRISPR effector protein.

19. The device of paragraph 18, wherein the RNA-targeting effector protein comprises one or more HEPN domains.

20. The device of paragraph 19, wherein the one or more HEPN domains comprise a RxxxxH motif sequence.

21. The device of paragraph 19, wherein the RxxxxH motif comprises a R[N/H/K]$X_1X_2X_3$H sequence.

22. The device of paragraph 21, wherein Xi is R, S, D, E, Q, N, G, or Y, and X2 is independently I, S, T, V, or L, and X3 is independently L, F, N, Y, V, I, S, D, E, or A.

23. The device of paragraph 18, wherein the RNA-targeting effector protein is C2c2.

24. The device of paragraph 23, wherein the C2c2 is within 20 kb of a Cas 1 gene.

25. The device of paragraph 23, wherein the C2c2 effector protein is from an organism of a genus selected from the group consisting of: Leptotrichia shahii; *Leptotrichia wadei* (Lw2); *Listeria seeligeri*; Lachnospiraceae bacterium MA2020; Lachnospiraceae bacterium NK4A179; [*Clostridium*] *aminophilum* DSM 10710; *Carnobacterium gallinarum* DSM 4847; *Carnobacterium gallinarum* DSM 4847 (second CRISPR Loci); *Paludibacter propionicigenes* WB4; *Listeria weihenstephanensis* FSL R9-0317; Listeriaceae bacterium FSL M6-0635; *Leptotrichia wadei* F0279; *Rhodobacter capsulatus* SB 1003; *Rhodobacter capsulatus* R121; *Rhodobacter capsulatus* DE442; *Leptotrichia buccalis* C-1013-b; *Herbinix hemicellulosilytica*; [*Eubacterium*] *rectale*; Eubacteriaceae bacterium CHKCI004; *Blautia* sp. *Marseille*-P2398; and *Leptotrichia* sp. oral taxon 879 str.F0557. Twelve (12) further non-limiting examples are: Lachnospiraceae bacterium NK4A144; *Chloroflexus aggregans*; *Demequina aurantiaca*; *Thalassospira* sp. TSL5-I; *Pseudobutyrivibrio* sp. OR37; *Butyrivibrio* sp. YAB3001; *Blautia* sp. *Marseille*-P2398; *Leptotrichia* sp. *Marseille*-P3007; *Bacteroides ihuae*; Porphyromonadaceae bacterium KH3CP3RA; *Listeria riparia*; and *Insolitispirillum peregrinum*.

26. The device of paragraph 25, wherein the C2c2 effector protein is a *L. wadei* F0279 or *L. wadei* F0279 (Lw2) C2c2 effector protein.

27. The device of any one of paragraphs 1 to 26, wherein the one or more guide RNAs are designed to detect a single nucleotide polymorphism in a target RNA or DNA, a splice variant of a RNA transcript, or a frameshift mutation in a target DNA or RNA.

28. The device of any one of paragraphs 1 to 27, wherein the one or more guide RNAs are designed to bind to one or more target RNA sequences that are diagnostic for a disease state.

29. The device of any one of paragraphs 1 to 28, further comprising a RNA-based masking construct, wherein the RNA-based masking construct suppresses generation of a detectable positive signal.

30. The device of any of paragraphs 1 to 28, further comprising a RNA-based masking construct that is a conductive RNA molecule located across conductive leads.

31. The device of paragraph 29, wherein the RNA-based masking construct suppresses generation of a detectable positive signal by masking the detectable positive signal, or generating a detectable negative signal instead.

32. The device of paragraph 29, wherein the RNA-based masking construct comprises a silencing RNA that suppresses generation of a gene product encoded by a reporting construct, wherein the gene product generates the detectable positive signal when expressed.

33. The device of paragraph 29, wherein the RNA-based masking construct is a ribozyme that generates the negative detectable signal, and wherein the positive detectable signal is generated when the ribozyme is deactivated.

34. The device of paragraph 33, wherein the ribozyme converts a substrate to a first color and wherein the substrate converts to a second color when the ribozyme is deactivated.

35. The device of paragraph 29, wherein the RNA-based masking agent is a RNA aptamer and/or comprises an RNA-tethered inhibitor.

36. The device of paragraph 35, wherein the aptamer or RNA-tethered inhibitor sequesters an enzyme, wherein the enzyme generates a detectable signal upon release from the aptamer or RNA tethered inhibitor by acting upon a substrate.

37. The device of paragraph 35, wherein the aptamer is an inhibitory aptamer that inhibits an enzyme and prevents the enzyme from catalyzing generation of a detectable signal from a substrate or wherein the RNA-tethered inhibitor inhibits an enzyme and prevents the enzyme from catalyzing generation of a detectable signal from a substrate.

38. The device of paragraph 35, wherein the aptamer sequesters a pair of agents that when released from the aptamers combine to generate a detectable signal.

39. The device of paragraph 29, wherein the RNA-based masking construct comprises a RNA oligonucleotide with a detectable ligand on a first end of the RNA oligonucleotide and a masking component on a second end of the RNA oligonucleotide.

40. The device of paragraph 39, wherein the detectable ligand is a fluorophore and the masking component is a quencher molecule.

41. The device of paragraph 39, wherein said masking construct comprises a RNA oligonucleotide designed to bind a G-quadruplex forming sequence, wherein a G-quadruplex structure is formed by the G-quadruplex forming sequence upon cleavage of the masking construct, and wherein the G-quadruplex structure generates a detectable positive signal.

42. The device of any one of paragraphs 1 to 40, wherein the RNA amplification reagents comprise nucleic acid sequence-based amplification (NASBA), recombinase polymerase amplification (RPA), loop-mediated isothermal amplification (LAMP), strand displacement amplification (SDA), helicase-dependent amplification (HDA), nicking enzyme amplification reaction (NEAR), PCR, multiple displacement amplification (MDA), rolling circle amplification (RCA), ligase chain reaction (LCR), or ramification amplification method (RAM).

43. The device of any of paragraphs 1 to 41, wherein the device comprises a heating element.

44. The device of paragraph 42, wherein the heating element is configured to heat the discrete volume to a predetermined temperature.

45. The device of paragraphs 41 or 43, wherein the heating element comprises a heating block having a groove contoured to receive and provide thermal contact with the discrete volume that contains the reaction mixture.

46. The device of paragraph 44, wherein the heating block is configured to move, whereby the heating block may be moved to contact the discrete volume.

47. The device of any of paragraphs 1 to 45, wherein the device comprises a mixing element.

48. The device of any of paragraphs 1 to 46, wherein the device comprises a pipetting element.

49. The device of paragraph 47, wherein the pipetting element is an acoustic dispenser.

50. The device of any of paragraphs 1 to 48, wherein the device comprises at least one reservoir for storing reagents.

51. The device of any of paragraphs 1 to 49, wherein the device comprises a cartridge configured for adding a sample and holding reagents, wherein the cartridge is removable from the device.

52. The device of any of paragraphs 1 to 50, further comprising a means for real-time fluorescence-based measurement of the unmasked masking agent, if present in said reaction mixture, during operation of the device.

53. The device of any of paragraphs 1 to 51, further comprising a controlling means for operating said device.

54. The device of paragraph 52, wherein the controlling means comprises a computer system, wireless computer system, smart phone, PDA, or tablet.

55. The device of paragraph 11, wherein the substrate comprises a lateral flow strip.

56. The device of paragraph 55, wherein the masking construct comprises a first molecule and a second molecule and the lateral flow strip comprises two capture lines with an anti-first molecule antibody hybridized at a first capture line and an anti-second molecule antibody hybridized at a second capture line.

57. The device of paragraph 56, wherein the first molecule is FITC.

58. The device of paragraphs 56 or 57, wherein the second molecule is biotin.

All publications, patents, and patent applications mentioned herein are incorporated by reference to the same extent as if each individual publication, patent or patent application was specifically and individually indicated to be incorporated by reference in its entirety.

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

SEQUENCE LISTING (622 sequences)

SEQ ID NO: 1 - protein, 1440 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTLKRPAATKKAGQAKKKKGSYPYDVPDYAYPYDVPDYAYPYDVPDYAEKIIEN

SEQ ID NO: 2 - protein, 1197 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEKRPAATKKAGQAKKKKGSYPYDVPDYAYPYDVPDYAYPYDVPDYA

SEQ ID NO: 3 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 4 - protein, 1340 aa, Lachnospiraceae bacterium MA2020
MQISKVNHKHVAVGQKDRERITGFIYNDPVGDEKSLEDVVAKRANDTKVLFNVFNTKDLYDSQESDKSEKDKEIISKGAKFVAKSFNSAITILKKQNKIYSTLTSQQVIKELKDKFGGARIYDDDIEEALTETLKKSFRKENVRNSIKVLIENAAGIRSSLSKDEEELIQEYFVKQLVEEYTKTKLQKNVVKSIKNQNMVIQPDSDSQVLSLSESRREKQSSAVSSDTLVNCKEKDVLKAFLTDYAVLDEDERNSLLWKLRNLVNLYFYGSESIRDYSYTKEKSVWKEHDEQKANKTLFIDEICHITKIGKNGKEQKVLDYEENRSRCRKQNINYYRSALNYAKNNTSGIFENEDSNHFWIHLIENEVERLYNGIENGEEFKFETGYISEKVWKAVINHLSIKYIALGKAVYNYAMKELSSPGDIEPGKIDDSYINGITSFDYEIIKAEESLQRDISMNVVFATNYLACATVDTDKDFLLFSKEDIRSCTKKDGNLCKNIMQFWGGYSTWKNFCEEYLKDDKDALELLYSLKSMLYSMRNSSFHFSTENVDNGSWDTELIGKLFEEDCNRAARIEKEKFYNNNLHMFYSSSLLEKVLERLYSSHHERASQVPSFNRVFVRKNFPSSLSEQRITPKFTDSKDEQIWQSAVYYLCKEIYYNDFLQSKEAYKLFREGVKNLDKNDINNQKAADSFKQAVVYYGKAIGNATLSQVCQAIMTEYNRQNNDGLKKKSAYAEKQNSNKYKHYPLFLKQVLQSAFWEYLDENKEIYGFISAQIHKSNVEIKAEDFIANYSSQQYKKLVDKVKKTPELQKWYTLGRLINPRQANQFLGSIRNYVQFVKDIQRRAKENGNPIRNYYEVLESDSIIKILEMCTKLNGTTSNDIHDYFRDEDEYAEYISQFVNFGDVHSGAALNAFCNSESEGKKNGIYYDGINPIVNRNWVLCKLYGSPDLISKIISRVNENMIHDFHKQEDLIREYQIKGICSNKKEQQDLRTFQVLKNRVELRDIVEYSEIINELYGQLIKWCYLRERDLMYFQLGFHYLCLNNASSKEADYIKINVDDRNISGAILYQIAAMYINGLPVYYKKDDMYVALKSGKKASDELNSNEQTSKKINYFLKYGNNILGDKKDQLYLAGLELFENVAEHENIIIFRNEIDHFHYFYDRDRSMLDLYSEVFDRFFTYDMKLRKNVVNMLYNILLDHNIVSSFVFETGEKKVGRGDSEVIKPSAKIRLRANNGVSSDVFTYKVGSKDELKIATLPAKNEEFLLNVARLIYYPDMEAVSENMVREGVVKVEKSNDKKGKISRGSNTRSSNQSKYNNKSKNRMNYSMGSIFEKMDLKFD

SEQ ID NO: 5 - protein, 1437 aa, Lachnospiraceae bacterium NK4A179
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 6 - protein, 1385 aa, Clostridium aminophilum DSM10710
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 7 - protein, 1175 aa, Carnobacterium gallinarum DSM4847
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 8 - protein, 1164 aa, Carnobacterium gallinarum DSM4847
MRMTKVKINGSPVSMNRSKLNGHLVWNGTTNTVNILTKKEQSFAASFLNKTLVKADQVKGYKVLAENIFIIFEQLEKSNSEKPSVYLNNIRRLKEAGLKRFFKSKYHEEIKYTSEKNQSVPTKLNLIPLFFNAVDRIQEDKFDEKNWSYFCKEMSPYLDYKKSYLNRKKEILANSIQQNRGFSMPTAEEPNLLSKRKQLFQQWAMKFQESPLIQQNNFAVEQFNKEFANKINELAAVYNVDELCTAITEKLMNFDKDKSNKTRNFEIKKLWKQHPHNKDKALIKLFNQEGNEALNQFNIELGKYFEHYFPKTGKKESAESYYLNPQTIIKTVGYQLRNAFVQYLLQVGKLHQYNKGVLDSQTLQEIGMYEGFQTKFMDACVFASSSLRNIIQATTNEDILTREKFKKELEKNVELKHDLFFKTEIVEERDENPAKKIAMTPNELDLWAIRGAVQRVRNQIFHQQINKRHEPNQLKVGSFENGDLGNVSYQKTIYQKLFDAEIKDIEIYFAEKIKSSGALEQYSMKDLEKLFSNKELTLSLGGQVVAFAPSYKKLYKQGYFYQNEKTIELEQFTDYDFSNDVFKANYYLIKLIYHYVFLPQFSQANNKLFKDTVHYVIQQNKELNTTEKDKKNNKKIRKYAFEQVKLMKNESPEKYMQYLQREMQEERTIKEAKKTNEEKPNYNFEKLLIQIFIKGFDTFLRNFDLNLNPAEELVGTVKEKAEGLRKRKERIAKILNVDEQIKTGDEEIAFWIFAKLLDARHLSELRNEMIKFKQSSVKKGLIKNGDLIEQMQPILELCILSNDSESMEKESFDKIEVFLEKVELAKNEPYMQEDKLTPVKFRFMKQLEKYQTRNFIENLVIENPEFKVSEKIVLNWHEEKEKIADLVDKRTKLHEEWASKAREIEEYNEKIKKNKSKKLDKPAEFAKFAEYKIICEAIENFNRLDHKVRLTYLKNLHYLMIDLMGRMVGFSVLFERDFVYMGRSYSALKKQSIYLNDYDTFANIRDWEVNENKHLFGTSSSDLTFQETAEFKNLKKPMENQLKALLGVTNHSFEIRNNIAHLHVLRNDGKGEGVSLLSCMNDLRKLMSYDRKLKNAVTKAIIKILDKHGMILKLTNNDHTKPFEIESLKPKKIIHLEKSNHSFPMDQVSQEYCDLVKKMLVFTN

SEQ ID NO: 9 - protein, 1154 aa, Paludibacter propionicigenes WB4
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 10 - protein, 970 aa, Listeria weihenstephanensis FSLR9-0317
MLALLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKVVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGDFKKNLPNSTTQSDVVKKMIPFFSDEIQNVNFDEAIWAIRGSIQQIRNEVYHCKKHSWKSILKIKGFEFEPNNMKYTDSDMQKLMDKDIAKIPDFIEEKLKSSGIIRFYSHDKLQSIWEMKQGFSLLTTNAPFVPSFKRVYAKGHDYQTSKNRYYDLGLTTFDILEYGEEDFRARYFLTKLVYYQQFMPWFTADNNAFRDAANFVLRLNKNRQQDAKAFINIREVEEGEMPRDYMGYVQGQIAIHEDSTEDTPNHFEKFISQVFIKGFDSHMRSADLKFIKNPRNQGLEQSEIEEMSFDIKVEPSFLKNKDDYIAFWTFCKMLDARHLSELRNEMIKYDGHLTGEQEIIGLALLGVDSRENDWKQFFSSEREYEKIMKGYVGEELYQREPYRQSDGKTPILFRGVEQARKYGTETVIQRLFDASPEFKVSKCNITEWERQKETIEETIERRKELHNEWEKNPKKPQNNAFFKEYKECCDAIDAYNWHKNKTTLVYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGEKKIDNGYIETNQVSEEYCGIVKRLLEI

SEQ ID NO: 11 - protein, 1051 aa, Listeriaceae bacterium FSLM6-0645
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 12 - protein, 1152 aa, Leptotrichia wadei F0279
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 13 - protein, 1285 aa, Rhodobacter capsulatus SB1003
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRTSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 14 - protein, 1285 aa, Rhodobacter capsulatus R121
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 15 - protein, 1285 aa, Rhodobacter capsulatus DE442; identical to SEQ ID NO: 14

SEQ ID NO: 16 - DNA, 47 bp, Artificial Sequence
  Synthetic
aattctaatacgactcactatagggggatcctctagaaatatggatt

SEQ ID NO: 17 - DNA, 22 bp, Artificial Sequence
  Synthetic
ctcgtatgttgtgtggaattgt

SEQ ID NO: 18 - DNA, 59 bp, Artificial Sequence
  Synthetic
aattctaatacgactcactatagggatcctctagaaatatggattacttggtagaacag

SEQ ID NO: 19 - DNA, 35 bp, Artificial Sequence
  Synthetic
gataaacacaggaaacagctatgaccatgattacg

SEQ ID NO: 20 - DNA, 54 bp, Artificial Sequence
  Synthetic
aattctaatacgactcactataggccgctgctaatgataggttgctactcacaa

SEQ ID NO: 21 - DNA, 34 bp, Artificial Sequence
  Synthetic
tcaatgtcagtcaccactattccatccacaacag

SEQ ID NO: 22 - DNA, 45 bp, Artificial Sequence
  Synthetic
gaaattaatacgactcactatagggcgtggcgcactacatgtact

SEQ ID NO: 23 - DNA, 30 bp, Artificial Sequence
  Synthetic
tgtcaatgtcagtcaccactattccatcca

SEQ ID NO: 24 - DNA, 49 bp, Artificial Sequence
  Synthetic
aattctaatacgactcactatagggtccagactcctacgggaggcwgca

SEQ ID NO: 25 - DNA, 52 bp, Artificial Sequence
  Synthetic
tttcgctctattctcatcagtttcatgtcctgtgtcattaccgcggctgctg

SEQ ID NO: 26 - DNA, 31 bp, Artificial Sequence
  Synthetic
ggtacacttcaggtatatttgaggttcattc

SEQ ID NO: 27 - DNA, 56 bp, Artificial Sequence
  Synthetic
gaaattaatacgactcactataggggttgatatgtcagagctttccagagaaataa

SEQ ID NO: 28 - DNA, 31 bp, Artificial Sequence
  Synthetic
acactaatattgattccttcagatatggact

SEQ ID NO: 29 - DNA, 55 bp, Artificial Sequence
  Synthetic
gaaattaatacgactcactatagggatcgttattcttacgcgttgtcattgaaag

SEQ ID NO: 30 - DNA, 30 bp, Artificial Sequence
  Synthetic
gaatctcttgaacccagtaggcagaggttg

SEQ ID NO: 31 - DNA, 57 bp, Artificial Sequence
  Synthetic
gaaattaatacgactcactatagggaaaggcctaagtgtccttctaccattattttg

SEQ ID NO: 32 - DNA, 32 bp, Artificial Sequence
  Synthetic
tttgtttttgatgttgttgttgtttttgtgtc

SEQ ID NO: 33 - DNA, 57 bp, Artificial Sequence
  Synthetic
gaaattaatacgactcactatagggaatgcattcatagccaaattctactggaaata

SEQ ID NO: 34 - DNA, 32 bp, Artificial Sequence
  Synthetic
gagtacgtccgcttcaccggctacccctgctc

SEQ ID NO: 35 - DNA, 57 bp, Artificial Sequence
  Synthetic
gaaattaatacgactcactatagggatagtcccctcggcgaacatggacccctacaa

SEQ ID NO: 36 - DNA, 57 bp, Artificial Sequence
  Synthetic
gaaattaatacgactcactatagggtcatgaagacctcacagtaaaaataggtgatt

SEQ ID NO: 37 - DNA, 32 bp, Artificial Sequence
  Synthetic
attcttaccatccacaaaatggatccagacaa

SEQ ID NO: 38 - DNA, 53 bp, Artificial Sequence
  Synthetic
gaaattaatacgactcactataggggcagcatgtcaagatcacagattttggg

SEQ ID NO: 39 - DNA, 29 bp, Artificial Sequence
  Synthetic
cctccttctgcatggtattctttctcttc

SEQ ID NO: 40 - DNA, 47 bp, Artificial Sequence; identical to SEQ ID NO: 16
  Synthetic

SEQ ID NO: 41 - DNA, 22 bp, Artificial Sequence
  Synthetic
ctcgtatgttgtgtggaattgt

SEQ ID NO: 42 - DNA, 49 bp, Artificial Sequence
  Synthetic
aattctaatacgactcactatagggggatcctctagaaatatggattac

SEQ ID NO: 43 - DNA, 22 bp, Artificial Sequence
  Synthetic
aaacacaggaaacagctatgac

SEQ ID NO: 44 - DNA, 49 bp, Artificial Sequence
  Synthetic
aattctaatacgactcactataggcctctagaaatatggattacttggt

SEQ ID NO: 45 - DNA, 22 bp, Artificial Sequence
  Synthetic
cgtatgttgtgtggaattgtga

SEQ ID NO: 46 - DNA, 60 bp, Artificial Sequence
  Synthetic
gaaattaatacgactcactatagggctgtcttgtctctcatggccgctggctggcttttc

SEQ ID NO: 47 - DNA, 33 bp, Artificial Sequence
  Synthetic
cgtacacaccgatggagccgccaaagtcctgtt

SEQ ID NO: 48 - DNA, 60 bp, Artificial Sequence
  Synthetic
gaaattaatacgactcactatagggagcaaatggaaactggcgaccaacggtttggcgat

SEQ ID NO: 49 - DNA, 32 bp, Artificial Sequence
  Synthetic
actgccccgaaacccggcatgtcgagatagga

SEQ ID NO: 50 - RNA, 67 nt, Artificial Sequence
  Synthetic
ggggauuuagacuaccccaaaaacgaaggggacuaaaacuagauugcuguucuaccaaguaauccau

SEQ ID NO: 51 - RNA, 28 nt, Artificial Sequence
  Synthetic
uagauugcuguucuaccaaguaauccau

SEQ ID NO: 52 - RNA, 67 nt, Artificial Sequence
  Synthetic
ggggauuuagacuaccccaaaaacgaaggggacuaaaaccauguagugcgccacgagcaaaaugaug

SEQ ID NO: 53 - RNA, 28 nt, Artificial Sequence
  Synthetic
cauguagugcgccacgagcaaaaugaug

SEQ ID NO: 54 - RNA, 67 nt, Artificial Sequence
  Synthetic
ggggauuuagacuaccccaaaaacgaaggggacuaaaacugcugccugcagcccugggaucaaguac

SEQ ID NO: 55 - RNA, 28 nt, Artificial Sequence
  Synthetic
ugcugccugcagcccugggaucaaguac

SEQ ID NO: 56 - RNA, 67 nt, Artificial Sequence
  Synthetic
ggggauuuagacuaccccaaaaacgaaggggacuaaaacacuuuacucccuuccuccccgcugaaag

SEQ ID NO: 57 - RNA, 28 nt, Artificial Sequence
  Synthetic
acuuuacucccuuccuccccgcugaaag

SEQ ID NO: 58 - RNA, 67 nt, Artificial Sequence
  Synthetic
ggggauuuagacuaccccaaaaacgaaggggacuaaaacaccucaucgccuuccuccccgcugaaag

SEQ ID NO: 59 - RNA, 28 nt, Artificial Sequence
  Synthetic
accucaucgccuuccuccccgcugaaag

SEQ ID NO: 60 - RNA, 67 nt, Artificial Sequence
  Synthetic
ggggauuuagacuaccccaaaaacgaaggggacuaaaacacuuacugcccuuccucccaacuuaaag

SEQ ID NO: 61 - RNA, 28 nt, Artificial Sequence
  Synthetic
acuuacugcccuuccucccaacuuaaag

SEQ ID NO: 62 - RNA, 67 nt, Artificial Sequence
  Synthetic
ggggauuuagacuaccccaaaaacgaaggggacuaaaacgaacccggaccuucgucgauggugaaag

SEQ ID NO: 63 - RNA, 28 nt, Artificial Sequence
  Synthetic
gaacccggaccuucgucgauggugaaag

SEQ ID NO: 64 - RNA, 67 nt, Artificial Sequence
  Synthetic
ggggauuuagacuaccccaaaaacgaaggggacuaaaacuuacacauauguucuucccuaauaacag

SEQ ID NO: 65 - RNA, 28 nt, Artificial Sequence
  Synthetic
uuacacauauguucuucccuaauaacag

SEQ ID NO: 66 - RNA, 67 nt, Artificial Sequence
  Synthetic
ggggauuuagacuaccccaaaaacgaaggggacuaaaacaugguuccgcgacgagguuggucagcgc

SEQ ID NO: 67 - RNA, 28 nt, Artificial Sequence
  Synthetic
augguuccgcgacgagguuggucagcgc

SEQ ID NO: 68 - RNA, 67 nt, Artificial Sequence
  Synthetic
ggggauuuagacuaccccaaaaacgaaggggacuaaaaccugccagacauucggugcgagcuggcgg

SEQ ID NO: 69 - RNA, 28 nt, Artificial Sequence
  Synthetic
cugccagacauucggugcgagcuggcgg

SEQ ID NO: 70 - RNA, 67 nt, Artificial Sequence
  Synthetic
ggggauuuagacuaccccaaaaacgaaggggacuaaaacaagauugcuguucuaccaaguaauccau

SEQ ID NO: 71 - RNA, 28 nt, Artificial Sequence
  Synthetic
aagauugcuguucuaccaaguaauccau

SEQ ID NO: 72 - RNA, 67 nt, Artificial Sequence
  Synthetic
ggggauuuagacuaccccaaaaacgaaggggacuaaaacuugauugcuguucuaccaaguaauccau

SEQ ID NO: 73 - RNA, 28 nt, Artificial Sequence
  Synthetic
uugauugcuguucuaccaaguaauccau

SEQ ID NO: 74 - RNA, 67 nt, Artificial Sequence
  Synthetic
ggggauuuagacuaccccaaaaacgaaggggacuaaaacuacauugcuguucuaccaaguaauccau

SEQ ID NO: 75 - RNA, 28 nt, Artificial Sequence
  Synthetic
uacauugcuguucuaccaaguaauccau

SEQ ID NO: 76 - RNA, 67 nt, Artificial Sequence
  Synthetic
ggggauuuagacuaccccaaaaacgaaggggacuaaaacuaguuugcuguucuaccaaguaauccau

SEQ ID NO: 77 - RNA, 28 nt, Artificial Sequence
  Synthetic
uaguuugcuguucuaccaaguaauccau

SEQ ID NO: 78 - RNA, 67 nt, Artificial Sequence
  Synthetic
ggggauuuagacuaccccaaaaacgaaggggacuaaaacuagaaugcuguucuaccaaguaauccau

SEQ ID NO: 79 - RNA, 28 nt, Artificial Sequence
  Synthetic
uagaaugcuguucuaccaaguaauccau

SEQ ID NO: 80 - RNA, 67 nt, Artificial Sequence
  Synthetic
ggggauuuagacuaccccaaaaacgaaggggacuaaaacuagauagcuguucuaccaaguaauccau

SEQ ID NO: 81 - RNA, 28 nt, Artificial Sequence
  Synthetic
uagauagcuguucuaccaaguaauccau

SEQ ID NO: 82 - RNA, 67 nt, Artificial Sequence
  Synthetic
ggggauuuagacuaccccaaaaacgaaggggacuaaaacuagauuccuguucuaccaaguaauccau

SEQ ID NO: 83 - RNA, 28 nt, Artificial Sequence
  Synthetic
uagauuccuguucuaccaaguaauccau

SEQ ID NO: 84 - RNA, 67 nt, Artificial Sequence
  Synthetic
ggggauuuagacuaccccaaaaacgaaggggacuaaaacuagauugguguucuaccaaguaauccau

SEQ ID NO: 85 - RNA, 28 nt, Artificial Sequence
  Synthetic
uagauugguguucuaccaaguaauccau

SEQ ID NO: 86 - RNA, 67 nt, Artificial Sequence
  Synthetic
ggggauuuagacuaccccaaaaacgaaggggacuaaaacuagauugcaguucuaccaaguaauccau

SEQ ID NO: 87 - RNA, 28 nt, Artificial Sequence
  Synthetic
uagauugcaguucuaccaaguaauccau

SEQ ID NO: 88 - RNA, 67 nt, Artificial Sequence
  Synthetic
ggggauuuagacuaccccaaaaacgaaggggacuaaaacuagauugcucuucuaccaaguaauccau

SEQ ID NO: 89 - RNA, 28 nt, Artificial Sequence
  Synthetic
uagauugcucuucuaccaaguaauccau

SEQ ID NO: 90 - RNA, 67 nt, Artificial Sequence
  Synthetic
ggggauuuagacuaccccaaaaacgaaggggacuaaaacggauacuucaugaugccagcugcuguuc

SEQ ID NO: 91 - RNA, 28 nt, Artificial Sequence
  Synthetic
ggauacuucaugaugccagcugcuguuc

SEQ ID NO: 92 - RNA, 67 nt, Artificial Sequence
  Synthetic
ggggauuuagacuaccccaaaaacgaaggggacuaaaacggauuguucaugaugccagcugcuguuc

SEQ ID NO: 93 - RNA, 28 nt, Artificial Sequence
  Synthetic
ggauuguucaugaugccagcugcuguuc

SEQ ID NO: 94 - RNA, 67 nt, Artificial Sequence
  Synthetic
ggggauuuagacuaccccaaaaacgaaggggacuaaaacggguacuucaugaugccagcugccguuc

SEQ ID NO: 95 - RNA, 28 nt, Artificial Sequence
  Synthetic
ggguacuucaugaugccagcugccguuc

SEQ ID NO: 96 - RNA, 67 nt, Artificial Sequence
  Synthetic
ggggauuuagacuaccccaaaaacgaaggggacuaaaacggguuguucaugaugccagcugccguuc

SEQ ID NO: 97 - RNA, 28 nt, Artificial Sequence
  Synthetic
ggguuguucaugaugccagcugccguuc

SEQ ID NO: 98 - RNA, 67 nt, Artificial Sequence
  Synthetic
ggggauuuagacuaccccaaaaacgaaggggacuaaaacgguuuaaucccuucugguguguugaugu

SEQ ID NO: 99 - RNA, 28 nt, Artificial Sequence
  Synthetic
gguuuaaucccuucugguguguugaugu

SEQ ID NO: 100 - RNA, 67 nt, Artificial Sequence
  Synthetic
ggggauuuagacuaccccaaaaacgaaggggacuaaaacgguaaaaucccuucugguguguugaugu

SEQ ID NO: 101 - RNA, 28 nt, Artificial Sequence
  Synthetic
gguaaaaucccuucugguguguugaugu

SEQ ID NO: 102 - RNA, 67 nt, Artificial Sequence
  Synthetic
ggggauuuagacuaccccaaaaacgaaggggacuaaaacggguuaaucccuucugguguguuuaugu

SEQ ID NO: 103 - RNA, 28 nt, Artificial Sequence
  Synthetic
ggguuaaucccuucugguguguuuaugu

SEQ ID NO: 104 - RNA, 67 nt, Artificial Sequence
  Synthetic
ggggauuuagacuaccccaaaaacgaaggggacuaaaacgggaaaaucccuucugguguguuuaugu

SEQ ID NO: 105 - RNA, 28 nt, Artificial Sequence
  Synthetic
gggaaaaucccuucugguguguuuaugu

SEQ ID NO: 106 - RNA, 62 nt, Artificial Sequence
  Synthetic
ggggauuuagacuaccccaaaaacgaaggggacuaaaacggauacuucaugaugccagcugc

SEQ ID NO: 107 - RNA, 23 nt, Artificial Sequence
  Synthetic
ggauacuucaugaugccagcugc

SEQ ID NO: 108 - RNA, 62 nt, Artificial Sequence
  Synthetic
ggggauuuagacuaccccaaaaacgaaggggacuaaaacggauuguucaugaugccagcugc

SEQ ID NO: 109 - RNA, 23 nt, Artificial Sequence
  Synthetic
ggauuguucaugaugccagcugc

SEQ ID NO: 110 - RNA, 62 nt, Artificial Sequence
  Synthetic
ggggauuuagacuaccccaaaaacgaaggggacuaaaacggguacuucaugaugccagcugc

SEQ ID NO: 111 - RNA, 23 nt, Artificial Sequence
  Synthetic
ggguacuucaugaugccagcugc

SEQ ID NO: 112 - RNA, 62 nt, Artificial Sequence
  Synthetic
ggggauuuagacuaccccaaaaacgaaggggacuaaaacggguuguucaugaugccagcugc

SEQ ID NO: 113 - RNA, 23 nt, Artificial Sequence
  Synthetic
ggguuguucaugaugccagcugc

SEQ ID NO: 114 - RNA, 67 nt, Artificial Sequence
  Synthetic
ggggauuuagacuaccccaaaaacgaaggggacuaaaacuacuacgcuucagccuacugcaaaucca

SEQ ID NO: 115 - RNA, 28 nt, Artificial Sequence
  Synthetic
uacuacgcuucagccuacugcaaaucca

SEQ ID NO: 116 - RNA, 67 nt, Artificial Sequence
  Synthetic
ggggauuuagacuaccccaaaaacgaaggggacuaaaacuauuacgcuucagccuacugcaaaucca

SEQ ID NO: 117 - RNA, 28 nt, Artificial Sequence
  Synthetic
uauuacgcuucagccuacugcaaaucca

SEQ ID NO: 118 - RNA, 67 nt, Artificial Sequence
  Synthetic
ggggauuuagacuaccccaaaaacgaaggggacuaaaacgacagaaauguccuuuucccaauccuau

SEQ ID NO: 119 - RNA, 28 nt, Artificial Sequence
  Synthetic
gacagaaauguccuuuucccaauccuau

SEQ ID NO: 120 - RNA, 67 nt, Artificial Sequence
  Synthetic
ggggauuuagacuaccccaaaaacgaaggggacuaaaacgauagaaauguccuuuucccaauccuau

SEQ ID NO: 121 - RNA, 28 nt, Artificial Sequence
  Synthetic
gauagaaauguccuuuucccaauccuau

SEQ ID NO: 122 - RNA, 67 nt, Artificial Sequence
  Synthetic
ggggauuuagacuaccccaaaaacgaaggggacuaaaacaccgacucuuuuuuguauuuccaguaga

SEQ ID NO: 123 - RNA, 28 nt, Artificial Sequence
  Synthetic
accgacucuuuuuuguauuuccaguaga

SEQ ID NO: 124 - RNA, 67 nt, Artificial Sequence
  Synthetic
ggggauuuagacuaccccaaaaacgaaggggacuaaaacacugacucuuuuuuguauuuccaguaga

SEQ ID NO: 125 - RNA, 28 nt, Artificial Sequence
  Synthetic
acugacucuuuuuuguauuuccaguaga

SEQ ID NO: 126 - RNA, 67 nt, Artificial Sequence
  Synthetic
ggggauuuagacuaccccaaaaacgaaggggacuaaaaccuacaccuucuaccaccaccuccgccag

SEQ ID NO: 127 - RNA, 28 nt, Artificial Sequence
  Synthetic
cuacaccuucuaccaccaccuccgccag

SEQ ID NO: 128 - RNA, 67 nt, Artificial Sequence
  Synthetic
ggggauuuagacuaccccaaaaacgaaggggacuaaaaccugcaccuucuaccaccaccuccgccag

SEQ ID NO: 129 - RNA, 28 nt, Artificial Sequence
  Synthetic
cugcaccuucuaccaccaccuccgccag

SEQ ID NO: 130 - RNA, 67 nt, Artificial Sequence
  Synthetic
ggggauuuagacuaccccaaaaacgaaggggacuaaaacgagagcaacaggaagcaggauuccaagu

SEQ ID NO: 131 - RNA, 28 nt, Artificial Sequence
  Synthetic
gagagcaacaggaagcaggauuccaagu

SEQ ID NO: 132 - RNA, 67 nt, Artificial Sequence
  Synthetic
ggggauuuagacuaccccaaaaacgaaggggacuaaaacgaaagcaacaggaagcaggauuccaagu

SEQ ID NO: 133 - RNA, 28 nt, Artificial Sequence
  Synthetic
gaaagcaacaggaagcaggauuccaagu

SEQ ID NO: 134 - RNA, 67 nt, Artificial Sequence
  Synthetic
ggggauuuagacuaccccaaaaacgaaggggacuaaaacccaggccaaaaucugugaucuugacaug

SEQ ID NO: 135 - RNA, 28 nt, Artificial Sequence
  Synthetic
ccaggccaaaaucugugaucuugacaug

SEQ ID NO: 136 - RNA, 67 nt, Artificial Sequence
  Synthetic
ggggauuuagacuaccccaaaaacgaaggggacuaaaaccccggccaaaaucugugaucuugacaug

SEQ ID NO: 137 - RNA, 28 nt, Artificial Sequence
  Synthetic
cccggccaaaaucugugaucuugacaug

SEQ ID NO: 138 - RNA, 67 nt, Artificial Sequence
  Synthetic
ggggauuuagacuaccccaaaaacgaaggggacuaaaacucaguguagcuagaccaaaaucaccuau

SEQ ID NO: 139 - RNA, 28 nt, Artificial Sequence
  Synthetic
ucaguguagcuagaccaaaaucaccuau

SEQ ID NO: 140 - RNA, 67 nt, Artificial Sequence
  Synthetic
ggggauuuagacuaccccaaaaacgaaggggacuaaaacucuguguagcuagaccaaaaucaccuau

SEQ ID NO: 141 - RNA, 28 nt, Artificial Sequence
  Synthetic
ucuguguagcuagaccaaaaucaccuau

SEQ ID NO: 142 - RNA, 44 nt, Leptotrichia wadei
  misc_feature (16)..(44): N represents any  nucleotide
gcaaggggacuaaaacnnnnnnnnnnnnnnnnnnnnnnnnnnnn

SEQ ID NO: 143 - RNA, 44 nt, Leptotrichia wadei
  misc_feature (7)..(44): "n" represents any nucleotide
cgaaggggacuaaaacnnnnnnnnnnnnnnnnnnnnnnnnnnnn

SEQ ID NO: 144 - RNA, 70 nt, Artificial Sequence
  Synthetic
uacccggggauccucuagaaauauggauuacuugguagaacagcaaucuacucgaccugcaggcaugcaa

SEQ ID NO: 145 - RNA, 44 nt, Artificial Sequence
  Synthetic
  misc_feature (11)..(11): "n" represents any nucleotide
gcaaggggacnaaaacuagauugcuguucuaccaaguaauccau

SEQ ID NO: 146 - DNA, 10 bp, Artificial Sequence
  Synthetic
tagattgctg

SEQ ID NO: 147 - DNA, 10 bp, Artificial Sequence
  Synthetic
aagattgctg

SEQ ID NO: 148 - DNA, 10 bp, Artificial Sequence
  Synthetic
ttgattgctg

SEQ ID NO: 149 - DNA, 10 bp, Artificial Sequence
  Synthetic
tacattgctg

SEQ ID NO: 150 - DNA, 10 bp, Artificial Sequence
  Synthetic
tagtttgctg

SEQ ID NO: 151 - DNA, 10 bp, Artificial Sequence
  Synthetic
tagaatgctg

SEQ ID NO: 152 - DNA, 10 bp, Artificial Sequence
  Synthetic
tagatagctg

SEQ ID NO: 153 - DNA, 10 bp, Artificial Sequence
  Synthetic
tagattcctg

SEQ ID NO: 154 - DNA, 10 bp, Artificial Sequence
  Synthetic
tagattggtg

SEQ ID NO: 155 - DNA, 10 bp, Artificial Sequence
  Synthetic
tagattgcag

SEQ ID NO: 156 - DNA, 10 bp, Artificial Sequence
  Synthetic
tagattgctc

SEQ ID NO: 157 - DNA, 10 bp, Artificial Sequence
  Synthetic
cagcaatcta

SEQ ID NO: 158 - DNA, 10 bp, Artificial Sequence
  Synthetic
cagcaatgta

SEQ ID NO: 159 - DNA, 10 bp, Artificial Sequence
  Synthetic
cagctatgta

SEQ ID NO: 160 - RNA, 58 nt, Flavivirus sp.
gugcugcccagaagagaacagcagcuggcaucaugaagaaucccguuguggauggaau

SEQ ID NO: 161 - RNA, 44 nt, Artificial Sequence
  Synthetic
gcaaggggacuaaaacggauacuucaugaugccagcugcuguuc

SEQ ID NO: 162 - RNA, 58 nt, Artificial Sequence; identical to SEQ ID NO: 160
  Synthetic

SEQ ID NO: 163 - RNA, 44 nt, Artificial Sequence; identical to SEQ ID NO: 161
  Synthetic

SEQ ID NO: 164 - RNA, 58 nt, Artificial Sequence
  Synthetic
gugcugcccagaagagaacggcagcuggcaucaugaagaaccccguuguggauggaau

SEQ ID NO: 165 - RNA, 58 nt, Flavivirus sp.; identical to SEQ ID NO: 160

SEQ ID NO: 166 - RNA, 28 nt, Flavivirus sp.
ggauuguucaugaugccagcugcuguuc

SEQ ID NO: 167 - RNA, 28 nt, Flavivirus sp.
ggauacuucaugaugccagcugcuguuc

SEQ ID NO: 168 - RNA, 58 nt, Flavivirus sp.
gugcugcccagaagagaacggcagcuggcaucaugaagaacccuguuguggauggaau

SEQ ID NO: 169 - RNA, 28 nt, Flavivirus sp.
ggguacuucaugaugccagcugccguuc

SEQ ID NO: 170 - RNA, 28 nt, Flavivirus sp.
ggguuguucaugaugccagcugccguuc

SEQ ID NO: 171 - RNA, 58 nt, Flavivirus sp.
aaaugcugcuggacaacaucaacacaccagaagggauuauaccagcucucuuugaacc

SEQ ID NO: 172 - RNA, 28 nt, Artificial Sequence
  Synthetic
gguaaaaucccuucugguguguugaugu

SEQ ID NO: 173 - RNA, 28 nt, Artificial Sequence
  Synthetic
gguuuaaucccuucugguguguugaugu

SEQ ID NO: 174 - RNA, 58 nt, Flavivirus sp
aaaugcuccuugacaacauaaacacaccagaagggauuaucccagcccucuuugagcc

SEQ ID NO: 175 - RNA, 28 nt, Artificial Sequence
  Synthetic
ggguuaaucccuucugguguguuuaugu

SEQ ID NO: 176 - RNA, 28 nt, Artificial Sequence
  Synthetic
gggaaaaucccuucugguguguuuaugu

SEQ ID NO: 177 - RNA, 39 nt, Artificial Sequence
  Synthetic
caccgcagcaugucaagaucacagauuuugggcgggcca

SEQ ID NO: 178 - RNA, 28 nt, Artificial Sequence
  Synthetic
cccggccaaaaucugugaucuugacaug

SEQ ID NO: 179 - RNA, 28 nt, Artificial Sequence
  Synthetic
ccaggccaaaaucugugaucuugacaug

SEQ ID NO: 180 - RNA, 39 nt, Artificial Sequence
  Synthetic
caguaaaaauaggugauuuuggucuagcuacagagaaau

SEQ ID NO: 181 - RNA, 28 nt, Artificial Sequence
  Synthetic
ucuguguagcuagaccaaaaucaccuau

SEQ ID NO: 182 - RNA, 28 nt, Artificial Sequence
  Synthetic
ucaguguagcuagaccaaaaucaccuau

SEQ ID NO: 183 - DNA, 25 bp, Artificial Sequence
  Synthetic
  misc_feature (25)..(): 3ThioM3-D
ttataactattcctaaaaaaaaaaa

SEQ ID NO: 184 - DNA, 26 bp, Artificial Sequence
  Synthetic
  misc_feature (1)..(1): 5ThioMC6-D
aaaaaaaaaactcccctaataacaat

SEQ ID NO: 185 - RNA, 45 nt, Artificial Sequence
  Synthetic
ggguaggaauaguuauaauuucccuuucccauuguuauuagggag

SEQ ID NO: 186 - DNA, 66 bp, Artificial Sequence
  Synthetic
tgtggttggtgtggttggttcatggtcatattggtttttttttttttttccaaccacagtctctgt

SEQ ID NO: 187 - DNA, 35 bp, Artificial Sequence
  Synthetic
ggttggtagtctcgaattgctctctttcactggcc

SEQ ID NO: 188 - DNA, 48 bp, Artificial Sequence
  Synthetic
gaaattaatacgactcactatagggggttggttcatggtcatattggt

SEQ ID NO: 189 - DNA, 57 bp, Artificial Sequence
  Synthetic
gaaattaatacgactcactatagggggttggtgtggttggttcatggtcatattggt

SEQ ID NO: 190 - DNA, 31 bp, Artificial Sequence
  Synthetic
ggccagtgaaagagagcaattcgagactacc

SEQ ID NO: 191 - RNA, 64 nt, Artificial Sequence
  Synthetic
gauuuagacuaccccaaaaacgaaggggacuaaaacccagugaaagagagcaauucgagacuac

SEQ ID NO: 192 - RNA, 64 nt, Artificial Sequence
  Synthetic
gauuuagacuaccccaaaaacgaaggggacuaaaacaaagagagcaauucgagacuaccaacca

SEQ ID NO: 193 - RNA, 64 nt, Artificial Sequence
  Synthetic
gauuuagacuaccccaaaaacgaaggggacuaaaacagacuaccaaccacagagacugugguug

SEQ ID NO: 194 - DNA, 106 bp, Artificial Sequence
  Synthetic
gttagatcgcaagcatatcattgcgcttgcgatctaactgctgcgccgccgggaaaatactgtacggttagatcgcatagtctcgaattgctctctttcactggcc

SEQ ID NO: 195 - DNA, 71 bp, Artificial Sequence
  Synthetic
gttagatcgcaagcatatcattgcgcttgcgatctaactgctgcgccgccgggaaaatactgtacggttag

SEQ ID NO: 196 - DNA, 35 bp, Artificial Sequence
  Synthetic
atcgcatagtctcgaattgctctctttcactggcc

SEQ ID NO: 197 - DNA, 50 bp, Artificial Sequence
  Synthetic
gaaattaatacgactcactatagggatcgcaagcatatcattgcgcttgc

SEQ ID NO: 198 - DNA, 31 bp, Artificial Sequence
  Synthetic
ggccagtgaaagagagcaattcgagactatg

SEQ ID NO: 199 - RNA, 64 nt, Artificial Sequence
  Synthetic
gauuuagacuaccccaaaaacgaaggggacuaaaacccagugaaagagagcaauucgagacuau

SEQ ID NO: 200 - RNA, 64 nt, Artificial Sequence
  Synthetic
gauuuagacuaccccaaaaacgaaggggacuaaaacagagcaauucgagacuaugcgaucuaac

SEQ ID NO: 201 - RNA, 64 nt, Artificial Sequence
  Synthetic
gauuuagacuaccccaaaaacgaaggggacuaaaacacuaugcgaucuaaccguacaguauuuu

SEQ ID NO: 202 - DNA, 66 bp, Artificial Sequence; identical to SEQ ID NO: 186
  Synthetic

SEQ ID NO: 203 - DNA, 25 bp, Artificial Sequence
  Synthetic
ggttggtagtctcgaattgctctct

SEQ ID NO: 204 - protein, 18 aa, Leptotrichia shahii
IRKFTKIGTNERNRILHA

SEQ ID NO: 205 - protein, 15 aa, Leptotrichia shahii
SIRNYISHFYIVRNP

SEQ ID NO: 206 - protein, 18 aa, Lachnospiraceae bacterium MA2020
LYSLKSMLYSMRNSSFHF

SEQ ID NO: 207 - protein, 15 aa, Lachnospiraceae bacterium MA2020
IFRNEIDHFHYFYDR

SEQ ID NO: 208 - protein, 18 aa, Lachnospiraceae
LTDLKDVIYSMRNDSFHY

SEQ ID NO: 209 - protein, 15 aa, Lachnospiraceae
ELRNYIEHFRYYSSF

SEQ ID NO: 210 - protein, 18 aa, Clostridium aminophilum DSM 10710
ADDLRKAIYSLRNETFHF

SEQ ID NO: 211 - protein, 15 aa, Clostridium aminophilum DSM 10710
DVRKYVDHFKYYATS

SEQ ID NO: 212 - protein, 18 aa, Carnobacterium gallinarum DSM 4847
IWALRGSVQQIRNEIFHS

SEQ ID NO: 213 - protein, 15 aa, Carnobacterium gallinarum
KIRNQTAHLSVLQLE

SEQ ID NO: 214 - protein, 18 aa, Carnobacterium gallinarum DSM 4847
LWAIRGAVQRVRNQIFHQ

SEQ ID NO: 215 - protein, 15 aa, Carnobacterium gallinarum DSM 4847
EIRNNIAHLHVLRND

SEQ ID NO: 216 - protein, 18 aa, Paludibacter propionicigenes WB4
LWGIRGAVQQIRNNVNHY

SEQ ID NO: 217 - protein, 15 aa, Paludibacter propionicigenes WB4
DIRNHIAHFNYLTKD

SEQ ID NO: 218 - protein, 18 aa, Listeria weihenstephanensis FSL R9-0317
IWAIRGSIQQIRNEVYHC

SEQ ID NO: 219 - protein, 15 aa, Listeria weihenstephanensis FSL R9-0317
NARNHIAHLNYLSLK

SEQ ID NO: 220 - protein, 18 aa, Listeriaceae bacterium FSL M6-0635
IWAIRGSIQQIRNEVYHC

SEQ ID NO: 221 - protein, 15 aa, Listeriaceae bacterium FSL M6-0635
NARNHIAHLNYLSLK

SEQ ID NO: 222 - protein, 18 aa, Leptotrichia wadei F0279
VFALLRYLRGCRNQTFHL

SEQ ID NO: 223 - protein, 15 aa, Leptotrichia wadei F0279
YIRNYIAHFNYIPHA

SEQ ID NO: 224 - protein, 18 aa, Rhodobacter capsulatus SB 1003
VFALLRYLRGCRNQTFHL

SEQ ID NO: 225 - protein, 15 aa, Artificial Sequence
  Synthetic
QTRKDLAHFNVLDRA

SEQ ID NO: 226 - protein, 18 aa, Rhodobacter capsulatus R12
VFALLRYLRGCRNQTFHL

SEQ ID NO: 227 - protein, 15 aa, Rhodobacter capsulatus R121
QTRKDLAHFNVLDRA

SEQ ID NO: 228 - protein, 18 aa, Rhodobacter capsulatus DE442
VFALLRYLRGCRNQTFHL

SEQ ID NO: 229 - protein, 15 aa, Rhodobacter capsulatus DE-442
QTRKDLAHFNVLDRA

SEQ ID NO: 230 - protein, 18 aa, Leptotrichia wadei (Lw2)
FANIDEAISSIRHGIVHF

SEQ ID NO: 231 - protein, 15 aa, Leptotrichia wadei (Lw2)
YIRNYIAHFNYIPHA

SEQ ID NO: 232 - protein, 18 aa, Listeria seeligen
SWGLRGAIAPIRNEIIHL

SEQ ID NO: 233 - protein, 15 aa, Listeria seeligen
EKRNNISHFNYLNGQ

SEQ ID NO: 234 - RNA, 62 nt, Artificial Sequence
  Synthetic
ggggauuuagacuaccccaaaaacgaaggggacuaaaacuagaaugcuguucuaccaaguaa

SEQ ID NO: 235 - RNA, 23 nt, Artificial Sequence
  Synthetic
uagaaugcuguucuaccaaguaa

SEQ ID NO: 236 - RNA, 62 nt, Artificial Sequence
  GGGGAUUUAGACUACCCCAAAAACGAAGGGGACUAAAACUAGAUAGCUGUUCUACCAAGUAA
ggggauuuagacuaccccaaaaacgaaggggacuaaaacuagauagcuguucuaccaaguaa

SEQ ID NO: 237 - RNA, 23 nt, Artificial Sequence
  Synthetic
uagauagcuguucuaccaaguaa

SEQ ID NO: 238 - RNA, 62 nt, Artificial Sequence
  Synthetic
ggggauuuagacuaccccaaaaacgaaggggacuaaaacuagauuccuguucuaccaaguaa

SEQ ID NO: 239 - RNA, 23 nt, Artificial Sequence
  Synthetic
uagauuccuguucuaccaaguaa

SEQ ID NO: 240 - RNA, 59 nt, Artificial Sequence
  Synthetic
ggggauuuagacuaccccaaaaacgaaggggacuaaaacaagauugcuguucuaccaag

SEQ ID NO: 241 - RNA, 20 nt, Artificial Sequence
  Synthetic
aagauugcuguucuaccaag

SEQ ID NO: 242 - RNA, 59 nt, Artificial Sequence
  Synthetic
ggggauuuagacuaccccaaaaacgaaggggacuaaaacuugauugcuguucuaccaag

SEQ ID NO: 243 - RNA, 20 nt, Artificial Sequence
  Synthetic
uugauugcuguucuaccaag

SEQ ID NO: 244 - RNA, 59 nt, Artificial Sequence
  Synthetic
ggggauuuagacuaccccaaaaacgaaggggacuaaaacuaguuugcuguucuaccaag

SEQ ID NO: 245 - RNA, 20 nt, Artificial Sequence
  Synthetic
uaguuugcuguucuaccaag

SEQ ID NO: 246 - RNA, 59 nt, Artificial Sequence
  Synthetic
ggggauuuagacuaccccaaaaacgaaggggacuaaaacuagaaugcuguucuaccaag

SEQ ID NO: 247 - RNA, 20 nt, Artificial Sequence
  Synthetic
uagaaugcuguucuaccaag

SEQ ID NO: 248 - RNA, 59 nt, Artificial Sequence
  Synthetic
ggggauuuagacuaccccaaaaacgaaggggacuaaaacuagauagcuguucuaccaag

SEQ ID NO: 249 - RNA, 20 nt, Artificial Sequence
  Synthetic
uagauagcuguucuaccaag

SEQ ID NO: 250 - RNA, 59 nt, Artificial Sequence
  Synthetic
ggggauuuagacuaccccaaaaacgaaggggacuaaaacuagauuccuguucuaccaag

SEQ ID NO: 251 - RNA, 20 nt, Artificial Sequence
  UAGAUUCCUGUUCUACCAAG
uagauuccuguucuaccaag

SEQ ID NO: 252 - RNA, 67 nt, Artificial Sequence
  Synthetic
ggggauuuagacuaccccaaaaacgaaggggacuaaaaccuagauugcuguucuaccaaguaaucca

SEQ ID NO: 253 - RNA, 28 nt, Artificial Sequence
  Synthetic
cuagauugcuguucuaccaaguaaucca

SEQ ID NO: 254 - RNA, 67 nt, Artificial Sequence
  Synthetic
ggggauuuagacuaccccaaaaacgaaggggacuaaaacgaagauugcuguucuaccaaguaaucca

SEQ ID NO: 255 - RNA, 28 nt, Artificial Seqeunce
  Synthetic
gaagauugcuguucuaccaaguaaucca

SEQ ID NO: 256 - RNA, 67 nt, Artificial Sequence
  Synthetic
ggggauuuagacuaccccaaaaacgaaggggacuaaaacguugauugcuguucuaccaaguaaucca

SEQ ID NO: 257 - RNA, 28 nt, Artificial Sequence
  Synthetic
guugauugcuguucuaccaaguaaucca

SEQ ID NO: 258 - RNA, 67 nt, Artificial Sequence
  Synthetic
ggggauuuagacuaccccaaaaacgaaggggacuaaaacguaguuugcuguucuaccaaguaaucca

SEQ ID NO: 259 - RNA, 28 nt, Artificial Sequence
  Synthetic
guaguuugcuguucuaccaaguaaucca

SEQ ID NO: 260 - RNA, 67 nt, Artificial Sequence
  Synthetic
ggggauuuagacuaccccaaaaacgaaggggacuaaaacguagaaugcuguucuaccaaguaaucca

SEQ ID NO: 261 - RNA, 28 nt, Artificial Sequence
  Synthetic
guagaaugcuguucuaccaaguaaucca

SEQ ID NO: 262 - RNA, 67 nt, Artificial Sequence
  Synthetic
ggggauuuagacuaccccaaaaacgaaggggacuaaaacguagauagcuguucuaccaaguaaucca

SEQ ID NO: 263 - RNA, 28 nt, Artificial Sequence
  Synthetic
guagauagcuguucuaccaaguaaucca

SEQ ID NO: 264 - RNA, 67 nt, Artificial Sequence
  Synthetic
ggggauuuagacuaccccaaaaacgaaggggacuaaaacacuagauugcuguucuaccaaguaaucc

SEQ ID NO: 265 - RNA, 28 nt, Artificial Sequence
  Synthetic
acuagauugcuguucuaccaaguaaucc

SEQ ID NO: 266 - RNA, 67 nt, Artificial Sequence
  Synthetic
ggggauuuagacuaccccaaaaacgaaggggacuaaaacagaagauugcuguucuaccaaguaaucc

SEQ ID NO: 267 - RNA, 28 nt, Artificial Sequence
  Synthetic
agaagauugcuguucuaccaaguaaucc

SEQ ID NO: 268 - RNA, 67 nt, Artificial Sequence
  Synthetic
ggggauuuagacuaccccaaaaacgaaggggacuaaaacaguugauugcuguucuaccaaguaaucc

SEQ ID NO: 269 - RNA, 28 nt, Artificial Sequence
  Synthetic
aguugauugcuguucuaccaaguaaucc

SEQ ID NO: 270 - RNA, 67 nt, Artificial Sequence
  Synthetic
ggggauuuagacuaccccaaaaacgaaggggacuaaaacaguaguuugcuguucuaccaaguaaucc

SEQ ID NO: 271 - RNA, 28 nt, Artificial Sequence
  Synthetic
aguaguuugcuguucuaccaaguaaucc

SEQ ID NO: 272 - RNA, 67 nt, Artificial Sequence
  Synthetic
ggggauuuagacuaccccaaaaacgaaggggacuaaaacaguagaaugcuguucuaccaaguaaucc

SEQ ID NO: 273 - RNA, 28 nt, Artificial Sequence
  Synthetic
aguagaaugcuguucuaccaaguaaucc

SEQ ID NO: 274 - RNA, 67 nt, Artificial Sequence
  Synthetic
ggggauuuagacuaccccaaaaacgaaggggacuaaaacaguagauagcuguucuaccaaguaaucc

SEQ ID NO: 275 - RNA, 28 nt, Artificial Sequence
  Synthetic
aguagauagcuguucuaccaaguaaucc

SEQ ID NO: 276 - RNA, 67 nt, Artificial Sequence
  Synthetic
ggggauuuagacuaccccaaaaacgaaggggacuaaaacgacuagauugcuguucuaccaaguaauc

SEQ ID NO: 277 - RNA, 28 nt, Artificial Sequence
  Synthetic
gacuagauugcuguucuaccaaguaauc

SEQ ID NO: 278 - RNA, 67 nt, Artificial Sequence
  Synthetic
ggggauuuagacuaccccaaaaacgaaggggacuaaaacgagaagauugcuguucuaccaaguaauc

SEQ ID NO: 279 - RNA, 28 nt, Artificial Sequence
  Synthetic
gagaagauugcuguucuaccaaguaauc

SEQ ID NO: 280 - RNA, 67 nt, Artificial Sequence
  Synthetic
ggggauuuagacuaccccaaaaacgaaggggacuaaaacgaguugauugcuguucuaccaaguaauc

SEQ ID NO: 281 - RNA, 28 nt, Artificial Sequence
  Synthetic
gaguugauugcuguucuaccaaguaauc

SEQ ID NO: 282 - RNA, 67 nt, Artificial Sequence
  Synthetic
ggggauuuagacuaccccaaaaacgaaggggacuaaaacgaguaguuugcuguucuaccaaguaauc

SEQ ID NO: 283 - RNA, 28 nt, Artificial Sequence
  Synthetic
gaguaguuugcuguucuaccaaguaauc

SEQ ID NO: 284 - RNA, 67 nt, Artificial Sequence
  Synthetic
ggggauuuagacuaccccaaaaacgaaggggacuaaaacgaguagaaugcuguucuaccaaguaauc

SEQ ID NO: 285 - RNA, 28 nt, Artificial Sequence
  Synthetic
gaguagaaugcuguucuaccaaguaauc

SEQ ID NO: 286 - RNA, 67 nt, Artificial Sequence
  Synthetic
ggggauuuagacuaccccaaaaacgaaggggacuaaaacgaguagauagcuguucuaccaaguaauc

SEQ ID NO: 287 - RNA, 28 nt, Artificial Sequence
  Synthetic
gaguagauagcuguucuaccaaguaauc

SEQ ID NO: 288 - RNA, 176 nt, Artificial Sequence
  Synthetic
gggggccagugaauucgagcucgguacccggggauccucuagaaauauggauuacuugguagaacagcaaucuacucgaccugcaggcaugcaagcuuggcguaaucauggucauagcuguuuccuguguuuauccgcucacaauuccacacaacauacgagccggaagcauaaag

SEQ ID NO: 289 - RNA, 176 nt, Artificial Sequence
  Synthetic
gggggccagugaauucgagcucgguacccggggauccucuagaaauauggauuacuugguagaacagcaaucuagucgaccugcaggcaugcaagcuuggcguaaucauggucauagcuguuuccuguguuuauccgcucacaauuccacacaacauacgagccggaagcauaaag

SEQ ID NO: 290 - RNA, 176 nt, Artificial Sequence
  Synthetic
gggggccagugaauucgagcucgguacccggggauccucuagaaauauggauuacuugguagaacagcaaucuaaucgaccugcaggcaugcaagcuuggcguaaucauggucauagcuguuuccuguguuuauccgcucacaauuccacacaacauacgagccggaagcauaaag

SEQ ID NO: 291 - RNA, 176 nt, Artificial Sequence
  Synthetic
gggggccagugaauucgagcucgguacccggggauccucuagaaauauggauuacuugguagaacagcaaucuauucgaccugcaggcaugcaagcuuggcguaaucauggucauagcuguuuccuguguuuauccgcucacaauuccacacaacauacgagccggaagcauaaag

SEQ ID NO: 292 - DNA, 173 bp, Artificial Sequence
  Synthetic
ggccagtgaattcgagctcggtacccggggatcctctagaaatatggattacttggtagaacagcaatctactcgacctgcaggcatgcaagcttggcgtaatcatggtcatagctgtttcctgtgtttatccgctcacaattccacacaacatacgagccggaagcataaag

SEQ ID NO: 293 - DNA, 189 bp, Artificial Sequence
  Synthetic
gagtacgtccgcttcaccggctacccctgctcctggaccttctaccaccacctccgccaggagatcctccaggagttcaccctgcacgaccacgtgcgggaggaggcccagaagttcctgcggggcctgcaggtgaacgggagccggccgggcacctttgtaggggtccatgttcgccgaggggactat

SEQ ID NO: 294 - RNA, 334 nt, Artificial Sequence
  Synthetic
agcuggaguguuguuugguaugggcaaagggaugccauucuacgcaugggacuuuggagucccgcugcuaaugauagguugcuacucacaauuaacaccccugacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacccccaaguggagaaaaagaugggacaggugcuacucauagcaguagccgucuccagcgccaua

SEQ ID NO: 295 - RNA, 334 nt, Artificial Sequence
  Synthetic
ggcagcuauauugaugggacuugacaagggauggccaauaucgaagauggacauaggaguuccacuucucgccuuagggugcuauucccaggugaacccauugacacugacagcggcgguguugauguuaguggcucauuaugccauaauuggaccaggacugcaagcaaaggccacuagagaagcucaaaaaaggacagcggccggaauaaugaaaaauccaaccguagacgggauuguugcaauagacuuggauccugugguuuaugauacaaaauuugaaaaacagcuaggccaaauaauguuacugauacuuuguacaucacagauccuc

SEQ ID NO: 296 - RNA, 337 nt, Artificial Sequence
  Synthetic
gggagcuggaguguuguuugguaugggcaaagggaugccauucuacgcaugggacuuuggagucccgcugcuaaugauagguugcuacucacaauuaacaccccugacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacccccaaguggagaaaaagaugggacaggugcuacucauagcaguagccgucuccagcgccaua

SEQ ID NO: 297 - RNA, 173 nt, Artificial Sequence
  Synthetic
gggaaccuugauaguggcuaucauucugcuuguggcacacuauauguacuugaucccaggccuacaggcagcagcagcgcgugcugcccagaagagaacagcagcuggcaucaugaagaaucccguuguggauggaauagugguaacugacauugacacaaugacaauugacc

SEQ ID NO: 298 - RNA, 173 nt, Artificial Sequence
  Synthetic
ggggacccuaauaguggccaucauuuugcucguggcgcacuacauguacuugaucccagggcugcaggcagcagcugcgcgugcugcccagaagagaacggcagcuggcaucaugaagaacccuguuguggauggaauaguggugacugacauugacacaaugacaauugacc

SEQ ID NO: 299 - RNA, 173 nt, Artificial Sequence
  Synthetic
gggaguacauauucaggggccaaccucucaacaaugacgaagaccaugcucacuggacagaagcaaaaaugcugcuggacaacaucaacacaccagaagggauuauaccagcucucuuugaaccagaaagggagaagucagccgccauagacggugaauaccgccugaagggu

SEQ ID NO: 300 - RNA, 173 nt, Artificial Sequence
  Synthetic
gggaguacauuuacaugggacagccuucaaacaacgaugaggaucacgcucauuggacagaagcaaaaaugcuccuugacaacauaaacacaccagaagggauuaucccagcccucuuugagccggagagaggaaaaagugcagcaauagacggggaauacagacugcggggu

SEQ ID NO: 301 - RNA, 176 nt, Artificial Sequence
  Synthetic
gggggccagugaauucgagcucgguacccggggauccucuagaaauauggauuacuugguagaacagcaauguacucgaccugcaggcaugcaagcuuggcguaaucauggucauagcuguuuccuguguuuauccgcucacaauuccacacaacauacgagccggaagcauaaag

SEQ ID NO: 302 - RNA, 176 nt, Artificial Sequence
  Synthetic
gggggccagugaauucgagcucgguacccggggauccucuagaaauauggauuacuugguagaacagcuauguacucgaccugcaggcaugcaagcuuggcguaaucauggucauagcuguuuccuguguuuauccgcucacaauuccacacaacauacgagccggaagcauaaag

SEQ ID NO: 303 - RNA, 62 nt, Artificial Sequence
  Synthetic
ggggauuuagacuaccccaaaaacgaaggggacuaaaacaagauugcuguucuaccaaguaa

SEQ ID NO: 304 - RNA, 23 nt, Artificial Sequence
  Synthetic
aagauugcuguucuaccaaguaa

SEQ ID NO: 305 - RNA, 62 nt, Artificial Sequence
  Synthetic
ggggauuuagacuaccccaaaaacgaaggggacuaaaacuugauugcuguucuaccaaguaa

SEQ ID NO: 306 - RNA, 23 nt, Artificial Sequence
  Synthetic
uugauugcuguucuaccaaguaa

SEQ ID NO: 307 - RNA, 62 nt, Artificial Sequence
  Synthetic
ggggauuuagacuaccccaaaaacgaaggggacuaaaacuaguuugcuguucuaccaaguaa

SEQ ID NO: 308 - RNA, 23 nt, Artificial Sequence
  Synthetic
uaguuugcuguucuaccaaguaa

SEQ ID NO: 309 - protein, 1159 aa, Leptorichia buccalis C-1013-b
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 310 - protein, 1285 aa, Herbinix hemicellulosilytica
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 311 - protein, 1344 aa, Eubacterium rectale
MLRRDKEVKKLYNVFNQIQVGTKPKKWNNDEKLSPEENERRAQQKNIKMKNYKWREACSKYVESSQRIINDVIFYSYRKAKNKLRYMRKNEDILKKMQEAEKLSKFSGGKLEDFVAYTLRKSLVVSKYDTQEFDSLAAMVVFLECIGKNNISDHEREIVCKLLELIRKDFSKLDPNVKGSQGANIVRSVRNQNMIVQPQGDRFLFPQVYAKENETVTNKNVEKEGLNEFLLNYANLDDEKRAESLRKLRRILDVYFSAPNHYEKDMDITLSDNIEKEKFNVWEKHECGKKETGLFVDIPDVLMEAEAENIKLDAVVEKRERKVLNDRVRKQNIICYRYTRAVVEKYNSNEPLFFENNAINQYWIHHIENAVERILKNCKAGKLFKLRKGYLAEKVWKDAINLISIKYIALGKAVYNFALDDIWKDKKNKELGIVDERIRNGITSFDYEMIKAHENLQRELAVDIAFSVNNLARAVCDMSNLGNKESDFLLWKRNDIADKLKNKDDMASVSAVLQFFGGKSSWDINIFKDAYKGKKKYNYEVRFIDDLRKAIYCARNENFHFKTALVNDEKWNTELFGKIFERETEFCLNVEKDRFYSNNLYMFYQVSELRNMLDHLYSRSVSRAAQVPSYNSVIVRTAFPEYITNVLGYQKPSYDADTLGKWYSACYYLLKEIYYNSFLQSDRALQLFEKSVKTLSWDDKKQQRAVDNFKDHFSDIKSACTSLAQVCQIYMTEYNQQNNQIKKVRSSNDSIFDQPVYQHYKVLLKKAIANAFADYLKNNKDLFGFIGKPFKANEIREIDKEQFLPDWTSRKYEALCIEVSGSQELQKWYIVGKFLNARSLNLMVGSMRSYIQYVTDIKRRAASIGNELHVSVHDVEKVEKWVQVIEVCSLLASRTSNQFEDYFNDKDDYARYLKSYVDFSNVDMPSEYSALVDFSNEEQSDLYVDPKNPKVNRNIVHSKLFAADHILRDIVEPVSKDNIEEFYSQKAEIAYCKIKGKEITAEEQKAVLKYQKLKNRVELRDIVEYGEIINELLGQLINWSFMRERDLLYFQLGFHYDCLRNDSKKPEGYKNIKVDENSIKDAILYQIIGMYVNGVTVYAPEKDGDKLKEQCVKGGVGVKVSAFHRYSKYLGLNEKTLYNAGLEIFEVVAEHEDIINLRNGIDHFKYYLGDYRSMLSIYSEVFDRFFTYDIKYQKNVLNLLQNILLRHNVIVEPILESGFKTIGEQTKPGAKLSIRSIKSDTFQYKVKGGTLITDAKDERYLETIRKILYYAENEEDNLKKSVVVTNADKYEKNKESDDQNKQKEKKNKDNKGKKNEETKSDAEKNNNERLSYNPFANLNFKLSN

SEQ ID NO: 312 - protein, 1373 aa, Eubacteriaceae bacterium CHKCI004
MKISKESHKRTAVAVMEDRVGGVVYVPGGSGIDLSNNLKKRSMDTKSLYNVFNQIQAGTAPSEYEWKDYLSEAENKKREAQKMIQKANYELRRECEDYAKKANLAVSRIIFSKKPKKIFSDDDIISHMKKQRLSKFKGRMEDFVLIALRKSLVVSTYNQEVFDSRKAATVFLKNIGKKNISADDERQIKQLMALIREDYDKWNPDKDSSDKKESSGTKVIRSIEHQNMVIQPEKNKLSLSKISNVGKKTKTKQKEKAGLDAFLKEYAQIDENSRMEYLKKLRRLLDTYFAAPSSYIKGAAVSLPENINFSSELNVWERHEAAKKVNINFVEIPESLLNAEQNNNKINKVEQEHSLEQLRTDIRRRNITCYHFANALAADERYHTLFFENMAMNQFWIHHMENAVERILKKCNVGTLFKLRIGYLSEKVWKDMLNLLSIKYIALGKAVYHFALDDIWKADIWKDASDKNSGKINDLTLKGISSFDYEMVKAQEDLQREMAVGVAFSTNNLARVTCKMDDLSDAESDFLLWNKEAIRRHVKYTEKGEILSAILQFFGGRSLWDESLFEKAYSDSNYELKFLDDLKRAIYAARNETFHFKTAAIDGGSWNTRLFGSLFEKEAGLCLNVEKNKFYSNNLVLFYKQEDLRVFLDKLYGKECSRAAQIPSYNTILPRKSFSDFMKQLLGLKEPVYGSAILDQWYSACYYLFKEVYYNLFLQDSSAKALFEKAVKALKGADKKQEKAVESFRKRYWEISKNASLAEICQSYITEYNQQNNKERKVRSANDGMFNEPIYQHYKMLLKEALKMAFASYIKNDKELKFVYKPTEKLFEVSQDNFLPNWNSEKYNTLISEVKNSPDLQKWYIVGKFMNARMLNLLLGSMRSYLQYVSDIQKRAAGLGENQLHLSAENVGQVKKWIQVLEVCLLLSVRISDKFTDYFKDEEEYASYLKEYVDFEDSAMPSDYSALLAFSNEGKIDLYVDASNPKVNRNIIQAKLYAPDMVLKKVVKKISQDECKEFNEKKEQIMQFKNKGDEVSWEEQQKILEYQKLKNRVELRDLSEYGELINELLGQLINWSYLRERDLLYFQLGFHYSCLMNESKKPDAYKTIRRGTVSIENAVLYQIIAMYINGFPVYAPEKGELKPQCKTGSAGQKIRAFCQWASMVEKKKYELYNAGLELFEVVKEHDNIIDLRNKIDHFKYYQGNDSILALYGEIFDRFFTYDMKYRNNVLNHLQNILLRHNVIIKPIISKDKKEVGRGKMKDRAAFLLEEVSSDRFTYKVKEGERKIDAKNRLYLETVRDILYFPNRAVNDKGEDVIICSKKAQDLNEKKADRDKNHDKSKDTNQKKEGKNQEEKSENKEPYSDRMTWKPFAGIKLE

SEQ ID NO: 313 - protein, 1334 aa, Lachnospiraceae bacterium NK4A144
MKISKVDHTRMAVAKGNQHRRDEISGILYKDPTKTGSIDFDERFKKLNCSAKILYHVFNGIAEGSNKYKNIVDKVNNNLDRVLFTGKSYDRKSIIDIDTVLRNVEKINAFDRISTEEREQIIDDLLEIQLRKGLRKGKAGLREVLLIGAGVIVRTDKKQEIADFLEILDEDFNKTNQAKNIKLSIENQGLVVSPVSRGEERIFDVSGAQKGKSSKKAQEKEALSAFLLDYADLDKNVRFEYLRKIRRLINLYFYVKNDDVMSLTEIPAEVNLEKDFDIWRDHEQRKEENGDFVGCPDILLADRDVKKSNSKQVKIAERQLRESIREKNIKRYRFSIKTIEKDDGTYFFANKQISVFWIHRIENAVERILGSINDKKLYRLRLGYLGEKVWKDILNFLSIKYIAVGKAVFNFAMDDLQEKDRDIEPGKISENAVNGLTSFDYEQIKADEMLQREVAVNVAFAANNLARVTVDIPQNGEKEDILLWNKSDIKKYKKNSKKGILKSILQFFGGASTWNMKMFEIAYHDQPGDYEENYLYDIIQIIYSLRNKSFHFKTYDHGDKNWNRELIGKMIEHDAERVISVEREKFHSNNLPMFYKDADLKKILDLLYSDYAGRASQVPAFNTVLVRKNFPEFLRKDMGYKVHFNNPEVENQWHSAVYYLYKEIYYNLFLRDKEVKNLFYTSLKNIRSEVSDKKQKLASDDFASRCEEIEDRSLPEICQIIMTEYNAQNFGNRKVKSQRVIEKNKDIFRHYKMLLIKTLAGAFSLYLKQERFAFIGKATPIPYETTDVKNFLPEWKSGMYASFVEEIKNNLDLQEWYIVGRFLNGRMLNQLAGSLRSYIQYAEDIERRAAENRNKLFSKPDEKIEACKKAVRVLDLCIKISTRISAEFTDYFDSEDDYADYLEKYLKYQDDAIKELSGSSYAALDHFCNKDDLKFDIYVNAGQKPILQRNIVMAKLFGPDNILSEVMEKVTESAIREYYDYLKKVSGYRVRGKCSTEKEQEDLLKFQRLKNAVEFRDVTEYAEVINELLGQLISWSYLRERDLLYFQLGFHYMCLKNKSFKPAEYVDIRRNNGTIIHNAILYQIVSMYINGLDFYSCDKEGKTLKPIETGKGVGSKIGQFIKYSQYLYNDPSYKLEIYNAGLEVFENIDEHDNITDLRKYVDHFKYYAYGNKMSLLDLYSEFFDRFFTYDMKYQKNVVNVLENILLRHFVIFYPKFGSGKKDVGIRDCKKERAQIEISEQSLTSEDFMFKLDDKAGEEAKKFPARDERYLQTIAKLLYYPNEIEDMNRFMKKGETINKKVQFNRKKKITRKQKNNSSNEVLSSTMGYLFKNIKL

SEQ ID NO: 314 - protein, 500 aa, Chlorofexus aggregans
MTDQVRREEVAAGELADTPLAAAQTPAADAAVAATPAPAEAVAPTPEQAVDQPATTGESEAPVTTAQAAAHEAEPAEATGASFTPVSEQQPQKPRRLKDLQPGMELEGKVTSIALYGIFVDVGVGRDGLVHISEMSDRRIDTPSELVQIGDTVKVWVKSVDLDARRISLTMLNPSRGEKPRRSRQSQPAQPQPRRQEVDREKLASLKVGEIVEGVITGFAPFGAFADIGVGKDGLIHISELSEGRVEKPEDAVKVGERYQFKVLEIDGEGTRISLSLRRAQRTQRMQQLEPGQIIEGTVSGIATFGAFVDIGVGRDGLVHISALAPHRVAKVEDVVKVGDKVKVKVLGVDPQSKRISLTMRLEEEQPATTAGDEAAEPAEEVTPTRRGNLERFAAAAQTARERSERGERSERGERRERRERRPAQSSPDTYIVGEDDDESFEGNATIEDLLTKFGGSSSRRDRDRRRRHEDDDDEEMERPSNRRQREAIRRTLQQIGYDE

SEQ ID NO: 315 - protein, 249 aa, Demequina aurantiaca
MDLTWHALLILFIVALLAGFLDTLAGGGGLLTVPALLLTGIPPLQALGTNKLQSSFGTGMATYQVIRKKRVHWRDVRWPMVWAFLGSAAGAVAVQFIDTDALLIIIPVVLALVAAYFLFVPKSHLPPPEPRMSDPAYEATLVPIIGAYDGAFGPGTGSLYALSGVALRAKTLVQSTAIAKTLNFATNFAALLVFAFAGHMLWTVGAVMIAGQLIGAYAGSHMLFRVNPLVLRVLIVVMSLGMLIRVLLD

SEQ ID NO: 316 - protein, 1235 aa, Thalassospira sp. TSL5-1
MRIIKPYGRSHVEGVATQEPRRKLRLNSSPDISRDIPGFAQSHDALIIAQWISAIDKIATKPKPDKKPTQAQINLRTTLGDAAWQHVMAENLLPAATDPAIREKLHLIWQSKIAPWGTARPQAEKDGKPTPKGGWYERFCGVLSPEAITQNVARQIAKDIYDHLHVAAKRKGREPAKQGESSNKPGKFKPDRKRGLIEERAESIAKNALRPGSHAPCPWGPDDQATYEQAGDVAGQIYAAARDCLEEKKRRSGNRNTSSVQYLPRDLAAKILYAQYGRVFGPDTTIKAALDEQPSLFALHKAIKDCYHRLINDARKRDILRILPRNMAALFRLVRAQYDNRDINALIRLGKVIHYHASEQGKSEHHGIRDYWPSQQDIQNSRFWGSDGQADIKRHEAFSRIWRHIIALASRTLHDWADPHSQKFSGENDDILLLAKDAIEDDVFKAGHYERKCDVLFGAQASLFCGAEDFEKAILKQAITGTGNLRNATFHFKGKVRFEKELQELTKDVPVEVQSAIAALWQKDAEGRTRQIAETLQAVLAGHFLTEEQNRHIFAALTAAMAQPGDVPLPRLRRVLARHDSICQRGRILPLSPCPDRAKLEESPALTCQYTVLKMLYDGPFRAWLAQQNSTILNHYIDSTIARTDKAARDMNGRKLAQAEKDLITSRAADLPRLSVDEKMGDFLARLTAATATEMRVQRGYQSDGENAQKQAAFIGQFECDVIGRAFADFLNQSGFDFVLKLKADTPQPDAAQCDVTALIAPDDISVSPPQAWQQVLYFILHLVPVDDASHLLHQIRKWQVLEGKEKPAQIAHDVQSVLMLYLDMHDAKFTGGAALHGIEKFAEFFAHAADFRAVFPPQSLQDQDRSIPRRGLREIVRFGHLPLLQHMSGTVQITHDNVVAWQAARTAGATGMSPIARRQKQREELHALAVERTARFRNADLQNYMHALVDVIKHRQLSAQVTLSDQVRLHRLMMGVLGRLVDYAGLWERDLYFVVLALLYHHGATPDDVFKGQGKKNLADGQVVAALKPKNRKAAAPVGVFDDLDHYGIYQDDRQSIRNGLSHFNMLRGGKAPDLSHWVNQTRSLVAHDRKLKNAVAKSVIEMLAREGFDLDWGIQTDRGQHILSHGKIRTRQAQHFQKSRLHIVKKSAKPDKNDTVKIRENLHGDAMVERVVQLFAAQVQKRYDITVEKRLDHLFLKPQDQKGKNGIHTHNGWSKTEKKRRPSRENRKGNHEN

SEQ ID NO: 317 - protein, 1312 aa, Pseudobutyrivibrio sp. OR37
MKFSKESHRKTAVGVTESNGIIGLLYKDPLNEKEKIEDVVNQRANSTKRLFNLFGTEATSKDISRASKDLAKVVNKAIGNLKGNKKFNKKEQITKGLNTKIIVEELKNVLKDEKKLIVNKDIIDEACSRLLKTSFRTAKTKQAVKMILTAVLIENTNLSKEDEAFVHEYFVKKLVNEYNKTSVKKQIPVALSNQNMVIQPNSVNGTLEISETKKSKETKTTEKDAFRAFLRDYATLDENRRHKMRLCLRNLVNLYFYGETSVSKDDFDEWRDHEDKKQNDELFVKKIVSIKTDRKGNVKEVLDVDATIDAIRTNNIACYRRALAYANENPDVFFSDTMLNKFWIHHVENEVERIYGHINNNTGDYKYQLGYLSEKVWKGIINYLSIKYIAEGKAVYNYAMNALAKDNNSNAFGKLDEKFVNGITSFEYERIKAEETLQRECAVNIAFAANHLANATVDLNEKDSDFLLLKHEDNKDTLGAVARPNILRNILQFFGGKSRWNDFDFSGIDEIQLLDDLRKMIYSLRNSSFHFKTENIDNDSWNTKLIGDMFAYDFNMAGNVQKDKMYSNNVPMFYSTSDIEKMLDRLYAEVHERASQVPSFNSVFVRKNFPDYLKNDLKITSAFGVDDALKWQSAVYYVCKEIYYNDFLQNPETFTMLKDYVQCLPIDIDKSMDQKLKSERNAHKNFKEAFATYCKECDSLSAICQMIMTEYNNQNKGNRKVISARTKDGDKLIYKHYKMILFEALKNVFTIYLEKNINTYGFLKKPKLINNVPAIEEFLPNYNGRQYETLVNRITEETELQKWYIVGRLLNPKQVNQLIGNFRSYVQYVNDVARRAKQTGNNLSNDNIAWDVKNIIQIFDVCTKLNGVTSNILEDYFDDGDDYARYLKNFVDYTNKNNDHSATLLGDFCAKEIDGIKIGIYHDGTNPIVNRNIIQCKLYGATGIISDLTKDGSILSVDYEIIKKYMQMQKEIKVYQQKGICKTKEEQQNLKKYQELKNIVELRNIIDYSEILDELQGQLINWGYLRERDLMYFQLGFHYLCLHNESKKPVGYNNAGDISGAVLYQIVAMYTNGLSLIDANGKSKKNAKASAGAKVGSFCSYSKEIRGVDKDTKEDDDPIYLAGVELFENINEHQQCINLRNYIEHFHYYAKHDRSMLDLYSEVFDRFFTYDMKYTKNVPNMMYNILLQHLVVPAFEFGSSEKRLDDNDEQTKPRAMFTLREKNGLSSEQFTYRLGDGNSTVKLSARGDDYLRAVASLLYYPDRAPEGLIRDAEAEDKFAKINHSNPKSDNRNNRGNFKNPKVQWYNNKTKRK

SEQ ID NO: 318 - protein, 1343 aa, Butyrivibrio sp. YAB3001
MKISKVDHRKTAVKITDNKGAEGFIYQDPTRDSSTMEQIISNRARSSKVLFNIFGDTKKSKDLNKYTESLIIYVNKAIKSLKGDKRNNKYEEITESLKTERVLNALIQAGNEFTCSENNIEDALNKYLKKSFRVGNTKSALKKLLMAAYCGYKLSIEEKEEIQNYFVDKLVKEYNKDTVLKYTAKSLKHQNMVVQPDTDNHVFLPSRIAGATQNKMSEKEALTEFLKAYAVLDEEKRHNLRIILRKLVNLYFYESPDFIYPENNEWKEHDDRKNKTETFVSPVKVNEEKNGKTFVKIDVPATKDLIRLKNIECYRRSVAETAGNPITYFTDHNISKFWIHHIENEVEKIFALLKSNWKDYQFSVGYISEKVWKEIINYLSIKYIAIGKAVYNYALEDIKKNDGTLNFGVIDPSFYDGINSFEYEKIKAEETFQREVAVYVSFAVNHLSSATVKLSEAQSDMLVLNKNDIEKIAYGNTKRNILQFFGGQSKWKEFDFDRYINPVNYTDIDFLFDIKKMVYSLRNESFHFTTTDTESDWNKNLISAMFEYECRRISTVQKNKFFSNNLPLFYGENSLERVLHKLYDDYVDRMSQVPSFGNVFVRKKFPDYMKEIGIKHNLSSEDNLKLQGALYFLYKEIYYNAFISSEKAMKIFVDLVNKLDTNARDDKGRITHEAMAHKNFKDAISHYMTHDCSLADICQKIMTEYNQQNTGHRKKQTTYSSEKNPEIFRHYKMILFMLLQKAMTEYISSEEIFDFIMKPNSPKTDIKEEEFLPQYKSCAYDNLIKLIADNVELQKWYITARLLSPREVNQLIGSFRSYKQFVSDIERRAKETNNSLSKSGMTVDVENITKVLDLCTKLNGRFSNELTDYFDSKDDYAVYVSKFLDFGFKIDEKFPAALLGEFCNKEENGKKIGIYHNGTEPILNSNIIKSKLYGITDVVSRAVKPVSEKLIREYLQQEVKIKPYLENGVCKNKEEQAALRKYQELKNRIEFRDIVEYSEIINELMGQLINFSYLRERDLMYFQLGFHYLCLNNYGAKPEGYYSIVNDKRTIKGAILYQIVAMYTYGLPIYHYVDGTISDRRKNKKTVLDTLNSSETVGAKIKYFIYYSDELFNDSLILYNAGLELFENINEHENIVNLRKYIDHFKYYVSQDRSLLDIYSEVFDRYFTYDRKYKKNVMNLFSNIMLKHFIITDFEFSTGEKTIGEKNTAKKECAKVRIKRGGLSSDKFTYKFKDAKPIELSAKNTEFLDGVARILYYPENVVLTDLVRNSEVEDEKRIEKYDRNHNSSPTRKDKTYKQDVKKNYNKKTSKAFDSSKLDTKSVGNNLSDNPVLKQFLSESKKKR

SEQ ID NO: 319 - protein, 1276 aa, Blautia sp Marseille-P2398
MKISKVDHVKSGIDQKLSSQRGMLYKQPQKKYEGKQLEEHVRNLSRKAKALYQVFPVSGNSKMEKELQIINSFIKNILLRLDSGKTSEEIVGYINTYSVASQISGDHIQELVDQHLKESLRKYTCVGDKRIYVPDIIVALLKSKFNSETLQYDNSELKILIDFIREDYLKEKQIKQIVHSIENNSTPLRIAEINGQKRLIPANVDNPKKSYIFEFLKEYAQSDPKGQESLLQHMRYLILLYLYGPDKITDDYCEEIEAWNFGSIVMDNEQLFSEEASMLIQDRIYVNQQIEEGRQSKDTAKVKKNKSKYRMLGDKIEHSINESVVKHYQEACKAVEEKDIPWIKYISDHVMSVYSSKNRVDLDKLSLPYLAKNTWNTWISFIAMKYVDMGKGVYHFAMSDVDKVGKQDNLIIGQIDPKFSDGISSFDYERIKAEDDLHRSMSGYIAFAVNNFARAICSDEFRKKNRKEDVLTVGLDEIPLYDNVKRKLLQYFGGASNWDDSIIDIIDDKDLVACIKENLYVARNVNFHFAGSEKVQKKQDDILEEIVRKETRDIGKHYRKVFYSNNVAVFYCDEDIIKLMNHLYQREKPYQAQIPSYNKVISKTYLPDLIFMLLKGKNRTKISDPSIMNMFRGTFYFLLKEIYYNDFLQASNLKEMFCEGLKNNVKNKKSEKPYQNFMRRFEELENMGMDFGEICQQIMTDYEQQNKQKKKTATAVMSEKDKKIRTLDNDTQKYKHFRTLLYIGLREAFIIYLKDEKNKEWYEFLREPVKREQPEEKEFVNKWKLNQYSDCSELILKDSLAAAWYVVAHFINQAQLNHLIGDIKNYIQFISDIDRRAKSTGNPVSESTEIQIERYRKILRVLEFAKFFCGQITNVLTDYYQDENDFSTHVGHYVKFEKKNMEPAHALQAFSNSLYACGKEKKKAGFYYDGMNPIVNRNITLASMYGNKKLLENAMNPVTEQDIRKYYSLMAELDSVLKNGAVCKSEDEQKNLRHFQNLKNRIELVDVLTLSELVNDLVAQLIGWVYIRERDMMYLQLGLHYIKLYFTDSVAEDSYLRTLDLEEGSIADGAVLYQIASLYSFNLPMYVKPNKSSVYCKKHVNSVATKFDIFEKEYCNGDETVIENGLRLFENINLHKDMVKFRDYLAHFKYFAKLDESILELYSKAYDFFFSYNIKLKKSVSYVLTNVLLSYFINAKLSFSTYKSSGNKTVQHRTTKISVVAQTDYFTYKLRSIVKNKNGVESIENDDRRCEVVNIAARDKEFVDEVCNVINYNSDK

SEQ ID NO: 320 - protein, 1168 aa, Leptotrichia sp. Marseille-P3007
MKITKIDGISHKKYIKEGKLVKSTSEENKTDERLSELLTIRLDTYIKNPDNASEEENRIRRENLKEFFSNKVLYLKDGILYLKDRREKNQLQNKNYSEEDISEYDLKNKNNFLVLKKILLNEDINSEELEIFRNDFEKKLDKINSLKYSLEENKANYQKINENNIKKVEGKSKRNIFYNYYKDSAKRNDYINNIQEAFDKLYKKEDIENLFFLIENSKKHEKYKIRECYHKIIGRKNDKENFATIIYEEIQNVNNMKELIEKVPNVSELKKSQVFYKYYLNKEKLNDENIKYVFCHFVEIEMSKLLKNYVYKKPSNISNDKVKRIFEYQSLKKLIENKLLNKLDTYVRNCGKYSFYLQDGEIATSDFIVGNRQNEAFLRNIIGVSSTAYFSLRNILETENENDITGRMRGKTVKNNKGEEKYISGEIDKLYDNNKQNEVKKNLKMFYSYDFNMNSKKEIEDFFSNIDEAISSIRHGIVHFNLELEGKDIFTFKNIVPSQISKKMFHDEINEKKLKLKIFKQLNSANVFRYLEKYKILNYLNRTRFEFVNKNIPFVPSFTKLYSRIDDLKNSLGIYWKTPKTNDDNKTKEITDAQIYLLKNIYYGEFLNYFMSNNGNFFEITKEIIELNKNDKRNLKTGFYKLQKFENLQEKTPKEYLANIQSLYMINAGNQDEEEKDTYIDFIQKIFLKGFMTYLANNGRLSLIYIGSDEETNTSLAEKKQEFDKFLKKYEQNNNIEIPYEINEFVREIKLGKILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKISDEAKYKISIEELKNYSKKKNEIEENHTTQENLHRKYARPRKDEKFTDEDYKKYEKAIRNIQQYTHLKNKVEFNELNLLQSLLLRILHRLVGYTSIWERDLRFRLKGEFPENQYIEEIFNFDNSKNVKYKNGQIVEKYINFYKELYKDDTEKISIYSDKKVKELKKEKKDLYIRNYIAHFNYIPNAEISLLEMLENLRKLLSYDRKLKNAIMKSIVDILKEYGFVVTFKIEKDKKIRIESLKSEEVVHLKKLKLKDNDKKKEPIKTYRNSKELCKLVKVMFEYKMKEKKSEN

SEQ ID NO: 321 - protein, 1138 aa, Bacterioides ihuae
MRITKVKVKESSDQKDKMVLIHRKVGEGTLVLDENLADLTAPIIDKYKDKSFELSLLKQTLVSEKEMNIPKCDKCTAKERCLSCKQREKRLKEVRGAIEKTIGAVIAGRDIIPRLNIFNEDEICWLIKPKLRNEFTFKDVNKQVVKLNLPKVLVEYSKKNDPTLFLAYQQWIAAYLKNKKGHIKKSILNNRVVIDYSDESKLSKRKQALELWGEEYETNQRIALESYHTSYNIGELVTLLPNPEEYVSDKGEIRPAFHYKLKNVLQMHQSTVFGTNEILCINPIFNENRANIQLSAYNLEVVKYFEHYFPIKKKKKNLSLNQAIYYLKVETLKERLSLQLENALRMNLLQKGKIKKHEFDKNTCSNTLSQIKRDEFFVLNLVEMCAFAANNIRNIVDKEQVNEILSKKDLCNSLSKNTIDKELCTKFYGADFSQIPVAIWAMRGSVQQIRNEIVHYKAEAIDKIFALKTFEYDDMEKDYSDTPFKQYLELSIEKIDSFFIEQLSSNDVLNYYCTEDVNKLLNKCKLSLRRTSIPFAPGFKTIYELGCHLQDSSNTYRIGHYLMLIGGRVANSTVTKASKAYPAYRFMLKLIYNHLFLNKFLDNHNKRFFMKAVAFVLKDNRENARNKFQYAFKEIRMMNNDESIASYMSYIHSLSVQEQEKKGDKNDKVRYNTEKFIEKVFVKGFDDFLSWLGVEFILSPNQEERDKTVTREEYENLMIKDRVEHSINSNQESHIAFFTFCKLLDANHLSDLRNEWIKFRSSGDKEGFSYNFAIDIIELCLLTVDRVEQRRDGYKEQTELKEYLSFFIKGNESENTVWKGFYFQQDNYTPVLYSPIELIRKYGTLELLKLIIVDEDKITQGEFEEWQTLKKVVEDKVTRRNELHQEWEDMKNKSSFSQEKCSIYQKLCRDIDRYNWLDNKLHLVHLRKLHNLVIQILSRMARFIALWDRDFVLLDASRANDDYKLLSFFNFRDFINAKKTKTDDELLAEFGSKIEKKNAPFIKAEDVPLMVECIEAKRSFYQKVFFRNNLQVLADRNFIAHYNYISKTAKCSLFEMIIKLRTLMYYDRKLRNAVVKSIANVFDQNGMVLQLSLDDSHELKVDKVISKRIVHLKNNNIMTDQVPEEYYKICRRLLEMKK

SEQ ID NO: 322 - protein, 697 aa, Porphyromonadaceae bacterium KH3CP3RA
MEFRDSIFKSLLQKEIEKAPLCFAEKLISGGVFSYYPSERLKEFVGNHPFSLFRKTMPFSPGFKRVMKSGGNYQNANRDGRFYDLDIGVYLPKDGFGDEEWNARYFLMKLIYNQLFLPYFADAENHLFRECVDFVKRVNRDYNCKNNNSEEQAFIDIRSMREDESIADYLAFIQSNIIIEENKKKETNKEGQINFNKFLLQVFVKGFDSFLKDRTELNFLQLPELQGDGTRGDDLESLDKLGAVVAVDLKLDATGIDADLNENISFYTFCKLLDSNHLSRLRNEIIKYQSANSDFSHNEDFDYDRIISIIELCMLSADHVSTNDNESIFPNNDKDFSGIRPYLSTDAKVETFEDLYVHSDAKTPITNATMVLNWKYGTDKLFERLMISDQDFLVTEKDYFVWKELKKDIEEKIKLREELHSLWVNTPKGKKGAKKKNGRETTGEFSEENKKEYLEVCREIDRYVNLDNKLHFVHLKRMHSLLIELLGRFVGFTYLFERDYQYYHLEIRSRRNKDAGVVDKLEYNKIKDQNKYDKDDFFACTFLYEKANKVRNFIAHFNYLTMWNSPQEEEHNSNLSGAKNSSGRQNLKCSLTELINELREVMSYDRKLKNAVTKAVIDLFDKHGMVIKFRIVNNNNNDNKNKHHLELDDIVPKKIMHLRGIKLKRQDGKPIPIQTDSVDPLYCRMWKKLLDLKPTPF

SEQ ID NO: 323 - protein, 204 aa, Listeria riparia
MHDAWAENPKKPQSDAFLKEYKACCEAIDTYNWHKNKATLVYVNELHHLLIDILGRLVGYVAIADRDFQCMANQYLKSSGHTERVDSWINTIRKNRPDYIEKLDIFMNKAGLFVSEKNGRNYIAHLNYLSPKHKYSLLYLFEKLREMLKYDRKLKNAVTKSLIDLLDKHGMCVVFANLKNNKHRLVIASLKPKKIETFKWKKIK

SEQ ID NO: 324 - protein, 1082 aa, Insolitispirillum peregrinum
MRIIRPYGSSTVASPSPQDAQPLRSLQRQNGTFDVAEFSRRHPELVLAQWVAMLDKIIRKPAPGKNSTALPRPTAEQRRLRQQVGAALWAEMQRHTPVPPELKAVWDSKVHPYSKDNAPATAKTPSHRGRWYDRFGDPETSAATVAEGVRRHLLDSAQPFRANGGQPKGKGVIEHRALTIQNGTLLHHHQSEKAGPLPEDWSTYRADELVSTIGKDARWIKVAASLYQHYGRIFGPTTPISEAQTRPEFVLHTAVKAYYRRLFKERKLPAERLERLLPRTGEALRHAVTVQHGNRSLADAVRIGKILHYGWLQNGEPDPWPDDAALYSSRYWGSDGQTDIKHSEAVSRVWRRALTAAQRTLTSWLYPAGTDAGDILLIGQKPDSIDRNRLPLLYGDSTRHWTRSPGDVWLFLKQTLENLRNSSFHFKTLSAFTSHLDGTCESEPAEQQAAQALWQDDRQQDHQQVFLSLRALDATTYLPTGPLHRIVNAVQSTDATLPLPRFRRVVTRAANTRLKGFPVEPVNRRTMEDDPLLRCRYGVLKLLYERGFRAWLETRPSIASCLDQSLKRSTKAAQTINGKNSPQGVEILSRATKLLQAEGGGGHGIHDLFDRLYAATAREMRVQVGYHHDAEAARQQAEFIEDLKCEVVARAFCAYLKTLGIQGDTFRRQPEPLPTWPDLPDLPSSTIGTAQAALYSVLHLMPVEDVGSLLHQLRRWLVALQARGGEDGTAITATIPLLELYLNRHDAKFSGGGAGTGLRWDDWQVFFDCQATFDRVFPPGPALDSHRLPLRGLREVLRFGRVNDLAALIGQDKITAAEVDRWHTAEQTIAAQQQRREALHEQLSRKKGTDAEVDEYRALVTAIADHRHLTAHVTLSNVVRLHRLMTTVLGRLVDYGGLWERDLTFVTLYEAHRLGGLRNLLSESRVNKFLDGQTPAALSKKNNAEENGMISKVLGDKARRQIRNDFAHFNMLQQGKKTINLTDEINNARKLMAHDRKLKNAITRSVTTLLQQDGLDIVWTMDASHRLTDAKIDSRNAIHLHKTHNRANIREPLHGKSYCRWVAALFGATSTPSATKKSDKIR

SEQ ID NO: 325 - protein, 1001 aa, Artificial Sequence
  Consensus Sequence
  misc_feature (7)..(9): Xaa can be any naturally occurring amino acid
  misc_feature (11)..(11): Xaa can be any naturally occurring amino acid
  misc_feature (14)..(16): Xaa can be any naturally occurring amino acid
  misc_feature (20)..(20): Xaa can be any naturally occurring amino acid
  misc_feature (22)..(22): Xaa can be any naturally occurring amino acid
  misc_feature (29)..(29): Xaa can be any naturally occurring amino acid
  misc_feature (36)..(36): Xaa can be any naturally occurring amino acid
  misc_feature (42)..(43): Xaa can be any naturally occurring amino acid
  misc_feature (48)..(48): Xaa can be any naturally occurring amino acid
  misc_feature (52)..(53): Xaa can be any naturally occurring amino acid
  misc_feature (57)..(57): Xaa can be any naturally occurring amino acid
  misc_feature (59)..(59): Xaa can be any naturally occurring amino acid
  misc_feature (69)..(71): Xaa can be any naturally occurring amino acid
  misc_feature (73)..(73): Xaa can be any naturally occurring amino acid
  misc_feature (75)..(75): Xaa can be any naturally occurring amino acid
  misc_feature (78)..(79): Xaa can be any naturally occurring amino acid
  misc_feature (86)..(86): Xaa can be any naturally occurring amino acid
  misc_feature (89)..(89): Xaa can be any naturally occurring amino acid
  MISC_FEATURE (90)..(90): "Xaa" at position 90 is Amino Acid code "J" - Leu or Ile
  misc_feature (101)..(101): Xaa can be any naturally occurring amino acid
  misc_feature (104)..(104): Xaa can be any naturally occurring amino acid
  misc_feature (111)..(111): Xaa can be any naturally occurring amino acid
  misc_feature (116)..(116): Xaa can be any naturally occurring amino acid
  misc_feature (121)..(121): Xaa can be any naturally occurring amino acid
  misc_feature (128)..(130): Xaa can be any naturally occurring amino acid
  misc_feature (133)..(133): Xaa can be any naturally occurring amino acid
  misc_feature (145)..(145): Xaa can be any naturally occurring amino acid
  misc_feature (148)..(148): Xaa can be any naturally occurring amino acid
  misc_feature (167)..(167): Xaa can be any naturally occurring amino acid
  misc_feature (174)..(174): Xaa can be any naturally occurring amino acid
  misc_feature (192)..(192): Xaa can be any naturally occurring amino acid
  misc_feature (194)..(195): Xaa can be any naturally occurring amino acid
  misc_feature (199)..(199): Xaa can be any naturally occurring amino acid
  misc_feature (202)..(203): Xaa can be any naturally occurring amino acid
  misc_feature (206)..(206): Xaa can be any naturally occurring amino acid
  misc_feature (217)..(219): Xaa can be any naturally occurring amino acid
  misc_feature (228)..(228): Xaa can be any naturally occurring amino acid
  misc_feature (233)..(233): Xaa can be any naturally occurring amino acid
  MISC_FEATURE (236)..(236): "Xaa" at position 90 is Amino Acid code "J" - Leu or Ile
  misc_feature (243)..(243): Xaa can be any naturally occurring amino acid
  misc_feature (245)..(245): Xaa can be any naturally occurring amino acid
  misc_feature (262)..(262): Xaa can be any naturally occurring amino acid
  MISC_FEATURE (267)..(267): "Xaa" at position 90 is Amino Acid code "J" - Leu or Ile
  misc_feature (277)..(278): Xaa can be any naturally occurring amino acid
  misc_feature (282)..(282): Xaa can be any naturally occurring amino acid
  misc_feature (287)..(287): Xaa can be any naturally occurring amino acid
  misc_feature (307)..(307): Xaa can be any naturally occurring amino acid
  misc_feature (314)..(314): Xaa can be any naturally occurring amino acid
  misc_feature (320)..(321): Xaa can be any naturally occurring amino acid
  misc_feature (333)..(333): Xaa can be any naturally occurring amino acid
  misc_feature (343)..(343): Xaa can be any naturally occurring amino acid
  misc_feature (357)..(357): Xaa can be any naturally occurring amino acid
  misc_feature (367)..(367): Xaa can be any naturally occurring amino acid
  misc_feature (371)..(371): Xaa can be any naturally occurring amino acid
  misc_feature (374)..(375): Xaa can be any naturally occurring amino acid
  misc_feature (378)..(378): Xaa can be any naturally occurring amino acid
  misc_feature (392)..(392): Xaa can be any naturally occurring amino acid
  misc_feature (402)..(402): Xaa can be any naturally occurring amino acid
  misc_feature (414)..(415): Xaa can be any naturally occurring amino acid
  MISC_FEATURE (418)..(418): "Xaa" at position 90 is Amino Acid code "J" - Leu or Ile
  misc_feature (446)..(446): Xaa can be any naturally occurring amino acid
  misc_feature (448)..(449): Xaa can be any naturally occurring amino acid
  misc_feature (451)..(451): Xaa can be any naturally occurring amino acid
  misc_feature (467)..(467): Xaa can be any naturally occurring amino acid
  misc_feature (489)..(489): Xaa can be any naturally occurring amino acid
  misc_feature (500)..(500): Xaa can be any naturally occurring amino acid
  misc_feature (510)..(510): Xaa can be any naturally occurring amino acid
  misc_feature (514)..(514): Xaa can be any naturally occurring amino acid
  misc_feature (528)..(529): Xaa can be any naturally occurring amino acid
  misc_feature (532)..(532): Xaa can be any naturally occurring amino acid
  misc_feature (539)..(539): Xaa can be any naturally occurring amino acid
  misc_feature (547)..(548): Xaa can be any naturally occurring amino acid
  misc_feature (551)..(551): Xaa can be any naturally occurring amino acid
  misc_feature (553)..(554): Xaa can be any naturally occurring amino acid
  misc_feature (565)..(565): Xaa can be any naturally occurring amino acid
  misc_feature (576)..(576): Xaa can be any naturally occurring amino acid
  misc_feature (587)..(588): Xaa can be any naturally occurring amino acid
  misc_feature (600)..(600): Xaa can be any naturally occurring amino acid
  misc_feature (604)..(605): Xaa can be any naturally occurring amino acid
  misc_feature (622)..(622): Xaa can be any naturally occurring amino acid
  misc_feature (627)..(627): Xaa can be any naturally occurring amino acid
  misc_feature (629)..(629): Xaa can be any naturally occurring amino acid
  misc_feature (655)..(655): Xaa can be any naturally occurring amino acid
  misc_feature (662)..(662): Xaa can be any naturally occurring amino acid
  misc_feature (682)..(682): Xaa can be any naturally occurring amino acid
  misc_feature (686)..(686): Xaa can be any naturally occurring amino acid
  MISC_FEATURE (688)..(688): "Xaa" at position 90 is Amino Acid code "J" - Leu or Ile
  misc_feature (691)..(691): Xaa can be any naturally occurring amino acid
  misc_feature (698)..(698): Xaa can be any naturally occurring amino acid
  misc_feature (706)..(706): Xaa can be any naturally occurring amino acid
  misc_feature (723)..(723): Xaa can be any naturally occurring amino acid
  MISC_FEATURE (737)..(737): "Xaa" at position 90 is Amino Acid code "J" - Leu or Ile
  misc_feature (738)..(738): Xaa can be any naturally occurring amino acid
  misc_feature (760)..(761): Xaa can be any naturally occurring amino acid
  misc_feature (771)..(771): Xaa can be any naturally occurring amino acid
  misc_feature (773)..(773): Xaa can be any naturally occurring amino acid
  misc_feature (779)..(779): Xaa can be any naturally occurring amino acid
  misc_feature (786)..(786): Xaa can be any naturally occurring amino acid
  misc_feature (790)..(790): Xaa can be any naturally occurring amino acid
  misc_feature (798)..(798): Xaa can be any naturally occurring amino acid
  misc_feature (800)..(800): Xaa can be any naturally occurring amino acid
  misc_feature (834)..(834): Xaa can be any naturally occurring amino acid
  misc_feature (843)..(843): Xaa can be any naturally occurring amino acid
  misc_feature (851)..(852): Xaa can be any naturally occurring amino acid
  misc_feature (866)..(866): Xaa can be any naturally occurring amino acid
  misc_feature (870)..(870): Xaa can be any naturally occurring amino acid
  misc_feature (873)..(873): Xaa can be any naturally occurring amino acid
  misc_feature (877)..(877): Xaa can be any naturally occurring amino acid
  misc_feature (889)..(889): Xaa can be any naturally occurring amino acid
  misc_feature (896)..(896): Xaa can be any naturally occurring amino acid
  misc_feature (916)..(916): Xaa can be any naturally occurring amino acid
  misc_feature (923)..(923): Xaa can be any naturally occurring amino acid
  misc_feature (936)..(936): Xaa can be any naturally occurring amino acid
  misc_feature (962)..(962): Xaa can be any naturally occurring amino acid
  misc_feature (966)..(966): Xaa can be any naturally occurring amino acid
  misc_feature (970)..(970): Xaa can be any naturally occurring amino acid
  misc_feature (985)..(985): Xaa can be any naturally occurring amino acid
  misc_feature (996)..(996): Xaa can be any naturally occurring amino acid
MKISKVXXXVXKKXXXGKLXKXVNERNRXAKRLSNXLBKYIXXIDKIXKKEXXKKFXAXEEITLKLNQXXXBXLXKAXXDLRKDNXYSXXKKILHNEDINXEEXELLINDXLEKLXKIESXKYSYQKXXXNYXMSVQEHSKKSIXRIXESAKRNKEALDKFLKEYAXLDPRMEXLAKLRKLLELYFYFKNDXIXXEEEXNVXXHKXLKENHPDFVEXXXNKENAELNXYAIEXKKXLKYYFPXKXAKNSNDKIFEKQELKKXWIHQXENAVERILLXXGKVXYKLQXGYLAELWKIRINEIFIKYIXVGKAVAXFALRNXXKBENDILGGKIXKKLNGITSFXYEKIKAEEILQREXAVEVAFAANXLYAXDLXXIRXSILQFFGGASNWDXFLFFHFATSXISDKKWNAELIXXKKXGLVIREKLYSNNVAMFYSKDDLEKLLNXLXXFXLRASQVPSFKKVYVRXBFPQNLLKKFNDEKDDEAYSAXYYLLKEIYYNXFLPYFSANNXFFFXVKNLVLKANKDKFXXAFXDIREMNXGSPIEYLXXTQXNXXNEGRKKEEKEXDFIKFLLQIFXKGFDDYLKNNXXFILKFIPEPTEXIEIXXELQAWYIVGKFLNARKXNLLGXFXSYLKLLDDIELRALRNENIKYQSSNXEKEVLEXCLELIGLLSLDLNDYFBDEXDFAXYXGKXLDFEKKXMKDLAELXPYDQNDGENPIVNRNIXLAKKYGTLNLLEKXXDKVSEKEIKEYYELKKEIEEYXXKGEELHEEWXQXKNRVEXRDILEYXEELXGQIINYNXLXNKVLLYFQLGLHYLLLDILGRLVGYTGIWERDAXLYQIAAMYXNGLPEYIXXKKNDKYKDGQIVGXKINXFKXDKKXLYNAGLELFENXNEHKNIXIRNYIAHFNYLSKAESSLLXYSENLRXLFSYDRKLKNAVXKSLINILLRHGMVLKFKFGTDKKSVXIRSXKKIXHLKSIAKKLYYPEVXVSKEYCKLVKXLLKYK

SEQ ID NO: 326 - protein, 1224 aa, Bergeyella zoohelcum
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 327 - protein, 1126 aa, Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 328 - protein, 1127 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 329 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 330 - protein, 1115 aa, Bacterioides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 331 - protein, 953 aa, Alistipes sp. ZOR0009
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 332 - protein, 1322 aa, Prevotella sp. MA2016
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 333 - protein, 1322 aa, Prevotella sp. MAS016; identical to SEQ ID NO: 332

SEQ ID NO: 334 - protein, 1095 aa, Riemeralla anatipesifer
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 335 - protein, 1124 aa, Prevotella aurantiaca
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 336 - protein, 1151 aa, Prevotella saccharolytica
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEKQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKELILEEEEGLGIATQMYKEVEKVVNRIKRIELFD

SEQ ID NO: 337 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 338 - protein, 1120 aa, Prevotella intermedia
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 339 - protein, 1199 aa, Capnocytophaga canimorsus
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 340 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 341 - protein, 1090 aa, Prevotella sp. P5-125
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 342 - protein, 1150 aa, Flavobacterium branchiphilum
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 343 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVTHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHIELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 344 - protein, 1214 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLIPFLEENKTDDKQNKTVSLRKYRKSKPNEETSITLTQSGLVFLMSFFLHRKEFQVFTSGLERFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNALQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLSTESTFLENGFIGLPPKILKKELSKRLKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKLNDSSLWNKVIHLSLQNNRITANPKLKDIGKYKRALQDEKIATLLTYDARTWTYALQKPEKENENDYKELHYTALNMELQEYEKVRSKELLKQVQELEKKILDKFYDFSNNASHPEDLEIEDKKGKRHPNFKLYITKALLKNESEIINLENIDIEILLKYYDYNTEELKEKIKNMDEDEKAKIINTKENYNKITNVLIKKALVLIIIRNKMAHNQYPPKFIYDLANRFVPKKEEEYFATYFNRVFETITKELWENKEKKDKTQV

SEQ ID NO: 345 - protein, 1119 aa, Porphyromonas gingivalis
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 346 - protein, 1175 aa, Porphyromonas sp. COT-052OH4946
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEDRAEEWERGKERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 347 - protein, 1132 aa, Prevotella intermedia
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 348 - protein, 1134 aa, Prevotella intermedia 17
MKMEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 349 - protein, 1133 aa, Prevotella intermedia
MEDDKKTTDSISYELKDKHFWAAFLNLARHNVYITVNHINKVLELKNKKDQDIIIDNDQDILAIKTHWEKVNGDLNKTERLRELMTKHFPFLETAIYSKNKEDKEEVKQEKQAKAQSFDSLKHCLFLFLEKLQETRNYYSHYKYSESTKEPMLEKELLKKMYNIFDDNIQLVIKDYQHNKDINPDEDFKHLDRTEEDFNYYFTRNKKGNITESGLLFFVSLFLEKKDAIWMQQKLRGFKDNRESKKKMTHEVFCRSRMLLPKLRLESTQTQDWILLDMLNELIRCPKSLYERLQGEDREKFKVPFDPADEDYDAEQEPFKNTLVRHQDRFPYFALRYFDYNEIFTNLRFQIDLGTFHFSIYKKLIGGQKEDRHLTHKLYGFERIQEFAKQNRPDEWKAIVKDLDTYETSNERYISETTPHYHLENQKIGIRFRNDNDEIWPSLKTNGENNEKSKYKLDKQYQAEAFLSVHELLPMMFYYLLLKKEEPNNDKKNASIVEGFIKREIRDMYKLYDAFANGEINNIDDLEKYCEDKGIPKRHLPKQMVAILYDEHKDMVKEAKRKQRKMVKDTEKLLAALEKQTQEKTEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSKEYEKVEALDRVGLVTKVIPLFFKKEDSKDKEEDLKKDAQKEINNCVQPFYSFPYNVGNIHKPDEKDFLHREERIELWDKKKDKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSEAELKSNPISKSLVEYELGEYQNARIETIKDMLLLEETLIEKYKNLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 350 - protein, 1127 aa, Prevotella buccae ATCC 33574; identical to SEQ ID NO: 328

SEQ ID NO: 351 - protein, 1125 aa, Prevotella pallens
MKEEEKGKTPVVSTYNKDDKHFWAAFLNLARHNVYITVNHINKILGEGEINRDGYENTLEKSWNEIKDINKKDRLSKLIIKHFPFLEVTTYQRNSADTTKQKEEKQAEAQSLESLKKSFFVFIYKLRDLRNHYSHYKHSKSLERPKFEEDLQEKMYNIFDASIQLVKEDYKHNTDIKTEEDFKHLDRKGQFKYSFADNEGNITESGLLFFVSLFLEKKDAIWVQKKLEGFKCSNESYQKMTNEVFCRSRMLLPKLRLQSTQTQDWILLDMLNELIRCPKSLYERLREEDRKKFRVPIEIADEDYDAEQEPFKNALVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDAFANGKINSIDKLEEYCKGKDIEIGHLPKQMIAILKSEHKDMATEAKRKQEEMLADVQKSLESLDNQINEEIENVERKNSSLKSGEIASWLVNDMMRFQPVQKDNEGNPLNNSKANSTEYQMLQRSLALYNKEEKPTRYFRQVNLIESSNPHPFLNNTEWEKCNNILSFYRSYLEAKKNFLESLKPEDWEKNQYFLMLKEPKTNCETLVQGWKNGFNLPRGIFTEPIRKWFMEHRKNITVAELKRVGLVAKVIPLFFSEEYKDSVQPFYNYLFNVGNINKPDEKNFLNCEERRELLRKKKDEFKKMTDKEKEENPSYLEFQSWNKFERELRLVRNQDIVTWLLCMELFNKKKIKELNVEKIYLKNINTNTTKKEKNTEEKNGEEKIIKEKNNILNRIMPMRLPIKVYGRENFSKNKKKKIRRNTFFTVYIEEKGTKLLKQGNFKALERDRRLGGLFSFVKTHSKAESKSNTISKSRVEYELGEYQKARIEIIKDMLALEETLIDKYNSLDTDNFHNMLTGWLKLKDEPDKASFQNDVDLLIAVRNAFSHNQYPMRNRIAFANINPFSLSSANTSEEKGLGIANQLKDKTHKTIEKIIEIEKPIETKE

SEQ ID NO: 352 - protein, 1157 aa, Myroides odoratimim
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKANYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMTEEFKSKWKGYQHTELQKLFAYYDTSKSDLDLILSDMVMVKDYPIELIALVKKSRTLVDFLNKYLEARLGYMENVITRVKNSIGTPQFKTVRKECFTFLKKSNYTVVSLDKQVERILSMPLFIERGFMDDKPTMLEGKSYQQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCEGLVRIDKVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLVPIGMDVREMLILSTDVKFIKEEIIQLGQAGEVEQDLYSLIYIRNKFAHNQLPIKEFFDFCENNYRSISDNEYYAEYYMEIFRSIKEKYTS

SEQ ID NO: 353 - protein, 1157 aa, Myoides odoratimim
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSDMVMVKDYPIELIDLVRKSRTLVDFLNKYLEARLGYIENVITRVKNSIGTPQFKTVRKECFAFLKESNYTVASLDKQIERILSMPLFIERGFMDSKPTMLEGKSYQQHKEDFADWFVHYKENSNYQNFYDTEVYEIITEDKREQAKVTKKIKQQQKNDVFTLMMVNYMLEEVLKLPSNDRLSLNELYQTKEERIVNKQVAKDTQERNKNYIWNKVVDLQLCEGLVRIDKVKLKDIGNFRKYENDSRVKEFLTYQSDIVWSGYLSNEVDSNKLYVIERQLDNYESIRSKELLKEVQEIECIVYNQVANKESLKQSGNENFKQYVLQGLLPRGTDVREMLILSTDVKFKKEEIMQLGQVREVEQDLYSLIYIRNKFAHNQLPIKEFFDFCENNYRPISDNEYYAEYYMEIFRSIKEKYAS

SEQ ID NO: 354 - protein, 1224 aa, Bergeyella zoohelcum; identical to SEQ ID NO: 326

SEQ ID NO: 355 - protein, 1150 aa, Prevotella saccharolytica
MMEKENVQGSHIYYEPTDKCFWAAFYNLARHNAYLTIAHINSFVNSKKGINNDDKVLDIIDDWSKFDNDLLMGARLNKLILKHFPFLKAPLYQLAKRKTRKQQGKEQQDYEKKGDEDPEVIQEAIANAFKMANVRKTLHAFLKQLEDLRNHFSHYNYNSPAKKMEVKFDDGFCNKLYYVFDAALQMVKDDNRMNPEINMQTDFEHLVRLGRNRKIPNTFKYNFTNSDGTINNNGLLFFVSLFLEKRDAIWMQKKIKGFKGGTENYMRMTNEVFCRNRMVIPKLRLETDYDNHQLMFDMLNELVRCPLSLYKRLKQEDQDKFRVPIEFLDEDNEADNPYQENANSDENPTEETDPLKNTLVRHQHRFPYFVLRYFDLNEVFKQLRFQINLGCYHFSIYDKTIGERTEKRHLTRTLFGFDRLQNFSVKLQPEHWKNMVKHLDTEESSDKPYLSDAMPHYQIENEKIGIHFLKTDTEKKETVWPSLEVEEVSSNRNKYKSEKNLTADAFLSTHELLPMMFYYQLLSSEEKTRAAAGDKVQGVLQSYRKKIFDIYDDFANGTINSMQKLDERLAKDNLLRGNMPQQMLAILEHQEPDMEQKAKEKLDRLITETKKRIGKLEDQFKQKVRIGKRRADLPKVGSIADWLVNDMMRFQPAKRNADNTGVPDSKANSTEYRLLQEALAFYSAYKDRLEPYFRQVNLIGGTNPHPFLHRVDWKKCNHLLSFYHDYLEAKEQYLSHLSPADWQKHQHFLLLKVRKDIQNEKKDWKKSLVAGWKNGFNLPRGLFTESIKTWFSTDADKVQITDTKLFENRVGLIAKLIPLYYDKVYNDKPQPFYQYPFNINDRYKPEDTRKRFTAASSKLWNEKKMLYKNAQPDSSDKIEYPQYLDFLSWKKLERELRMLRNQDMMVWLMCKDLFAQCTVEGVEFADLKLSQLEVDVNVQDNLNVLNNVSSMILPLSVYPSDAQGNVLRNSKPLHTVYVQENNTKLLKQGNFKSLLKDRRLNGLFSFIAAEGEDLQQHPLTKNRLEYELSIYQTMRISVFEQTLQLEKAILTRNKTLCGNNFNNLLNSWSEHRTDKKTLQPDIDFLIAVRNAFSHNQYPMSTNTVMQGIEKFNIQTPKLEEKDGLGIASQLAKKTKDAASRLQNIINGGTN

SEQ ID NO: 356 - protein, 1175 aa, Porphyromonas gingivalis
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 357 - protein, 1115 aa, Bacteroides pyrogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETTECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTGGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPVPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 358 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 359 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 360 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKIMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEIPLIYRDVSAKVGSIEGSSAKDLPEGSSLVDSLWKKYEMIIRKILPILDPENRFFGKLLNNMSQPINDL

SEQ ID NO: 361 - protein, 1125 aa, Prevotella intermedia ZT
MKMEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 362 - protein, 1161 aa, Bacterioides bacterium
MENQTQKGKGIYYYYTKNEDKHYFGSFLNLANNNIEQIIEEFRIRLSLKDEKNIKEIINNYFTDKKSYTDWERGINILKEYLPVIDYLDLAITDKEFEKIDLKQKETAKRKYFRTNFSLLIDTIIDLRNFYTHYFHKPISINPDVAKFLDKNLLNVCLDIKKQKMKTDKTKQALKDGLDKELKKLIELKKAELKEKKIKTWNITENVEGAVYNDAFNHMVYKNNAGVTILKDYHKSILPDDKIDSELKLNFSISGLVFLLSMFLSKKEIEQFKSNLEGFKGKVIGENGEYEISKFNNSLKYMATHWIFSYLTFKGLKQRVKNTFDKETLLMQMIDELNKVPHEVYQTLSKEQQNEFLEDINEYVQDNEENKKSMENSIVVHPVIRKRYDDKFNYFAIRFLDEFANFPTLKFFVTAGNFVHDKREKQIQGSMLTSDRMIKEKINVFGKLTEIAKYKSDYFSNENTLETSEWELFPNPSYLLIQNNIPVHIDLIHNTEEAKQCQIAIDRIKCTTNPAKKRNTRKSKEEIIKIIYQKNKNIKYGDPTALLSSNELPALIYELLVNKKSGKELENIIVEKIVNQYKTIAGFEKGQNLSNSLITKKLKKSEPNEDKINAEKIILAINRELEITENKLNIIKNNRAEFRTGAKRKHIFYSKELGQEATWIAYDLKRFMPEASRKEWKGFHHSELQKFLAFYDRNKNDAKALLNMFWNFDNDQLIGNDLNSAFREFHFDKFYEKYLIKRDEILEGFKSFISNFKDEPKLLKKGIKDIYRVFDKRYYIIKSTNAQKEQLLSKPICLPRGIFDNKPTYIEGVKVESNSALFADWYQYTYSDKHEFQSFYDMPRDYKEQFEKFELNNIKSIQNKKNLNKSDKFIYFRYKQDLKIKQIKSQDLFIKLMVDELFNVVFKNNIELNLKKLYQTSDERFKNQLIADVQKNREKGDTSDNKMNENFIWNMTIPLSLCNGQIEEPKVKLKDIGKFRKLETDDKVIQLLEYDKSKVWKKLEIEDELENMPNSYERIRREKLLKGIQEFEHFLLEKEKFDGINHPKHFEQDLNPNFKTYVINGVLRKNSKLNYTEIDKLLDLEHISIKDIETSAKEIHLAYFLIHVRNKFGHNQLPKLEAFELMKKYYKKNNEETYAEYFHKVSSQIVNEFKNSLEKHS

SEQ ID NO: 363 - protein, 1165 aa, Chryseobacterium jejuense
MEKTQTGLGIYYDHTKLQDKYFFGGFFNLAQNNIDNVIKAFIIKFFPERKDKDINIAQFLDICFKDNDADSDFQKKNKFLRIHFPVIGFLTSDNDKAGFKKKFALLLKTISELRNFYTHYYHKSIEFPSELFELLDDIFVKTTSEIKKLKKKDDKTQQLLNKNLSEEYDIRYQQQIERLKELKAQGKRVSLTDETAIRNGVFNAAFNHLIYRDGENVKPSRLYQSSYSEPDPAENGISLSQNSILFLLSMFLERKETEDLKSRVKGFKAKIIKQGEEQISGLKFMATHWVFSYLCFKGIKQKLSTEFHEETLLIQIIDELSKVPDEVYSAFDSKTKEKFLEDINEYMKEGNADLSLEDSKVIHPVIRKRYENKFNYFAIRFLDEYLSSTSLKFQVHVGNYVHDRRVKHINGTGFQTERIVKDRIKVFGRLSNISNLKADYIKEQLELPNDSNGWEIFPNPSYIFIDNNVPIHVLADEATKKGIELFKDKRRKEQPEELQKRKGKISKYNIVSMIYKEAKGKDKLRIDEPLALLSLNEIPALLYQILEKGATPKDIELIIKNKLTERFEKIKNYDPETPAPASQISKRLRNNTTAKGQEALNAEKLSLLIEREIENTETKLSSIEEKRLKAKKEQRRNTPQRSIFSNSDLGRIAAWLADDIKRFMPAEQRKNWKGYQHSQLQQSLAYFEKRPQEAFLLLKEGWDTSDGSSYWNNWVMNSFLENNHFEKFYKNYLMKRVKYFSELAGNIKQHTHNTKFLRKFIKQQMPADLFPKRHYILKDLETEKNKVLSKPLVFSRGLFDNNPTFIKGVKVTENPELFAEWYSYGYKTEHVFQHFYGWERDYNELLDSELQKGNSFAKNSIYYNRESQLDLIKLKQDLKIKKIKIQDLFLKRIAEKLFENVFNYPTTLSLDEFYLTQEERAEKERIALAQSLREEGDNSPNIIKDDFIWSKTIAFRSKQIYEPAIKLKDIGKFNRFVLDDEESKASKLLSYDKNKIWNKEQLERELSIGENSYEVIRREKLFKEIQNLELQILSNWSWDGINHPREFEMEDQKNTRHPNFKMYLVNGILRKNINLYKEDEDFWLESLKENDFKTLPSEVLETKSEMVQLLFLVILIRNQFAHNQLPEIQFYNFIRKNYPEIQNNTVAELYLNLIKLAVQKLKDNS

SEQ ID NO: 364 - protein, 1156 aa, Chryseobacterium carnipullorum
MNTRVTGMGVSYDHTKKEDKHFFGGFLNLAQDNITAVIKAFCIKFDKNPMSSVQFAESCFTDKDSDTDFQNKVRYVRTHLPVIGYLNYGGDRNTFRQKLSTLLKAVDSLRNFYTHYYHSPLALSTELFELLDTVFASVAVEVKQHKMKDDKTRQLLSKSLAEELDIRYKQQLERLKELKEQGKNIDLRDEAGIRNGVLNAAFNHLIYKEGEIAKPTLSYSSFYYGADSAENGITISQSGLLFLLSMFLGKKEIEDLKSRIRGFKAKIVRDGEENISGLKFMATHWIFSYLSFKGMKQRLSTDFHEETLLIQIIDELSKVPDEVYHDFDTATREKFVEDINEYIREGNEDFSLGDSTIIHPVIRKRYENKFNYFAVRFLDEFIKFPSLRFQVHLGNFVHDRRIKDIHGTGFQTERVVKDRIKVFGKLSEISSLKTEYIEKELDLDSDTGWEIFPNPSYVFIDNNIPIYISTNKTFKNGSSEFIKLRRKEKPEEMKMRGEDKKEKRDIASMIGNAGSLNSKTPLAMLSLNEMPALLYEILVKKTTPEEIELIIKEKLDSHFENIKNYDPEKPLPASQISKRLRNNTTDKGKKVINPEKLIHLINKEIDATEAKFALLAKNRKELKEKFRGKPLRQTIFSNMELGREATWLADDIKRFMPDILRKNWKGYQHNQLQQSLAFFNSRPKEAFTILQDGWDFADGSSFWNGWIINSFVKNRSFEYFYEAYFEGRKEYFSSLAENIKQHTSNHRNLRRFIDQQMPKGLFENRHYLLENLETEKNKILSKPLVFPRGLFDTKPTFIKGIKVDEQPELFAEWYQYGYSTEHVFQNFYGWERDYNDLLESELEKDNDFSKNSIHYSRTSQLELIKLKQDLKIKKIKIQDLFLKLIAGHIFENIFKYPASFSLDELYLTQEERLNKEQEALIQSQRKEGDHSDNIIKDNFIGSKTVTYESKQISEPNVKLKDIGKFNRFLLDDKVKTLLSYNEDKVWNKNDLDLELSIGENSYEVIRREKLFKKIQNFELQTLTDWPWNGTDHPEEFGTTDNKGVNHPNFKMYVVNGILRKHTDWFKEGEDNWLENLNETHFKNLSFQELETKSKSIQTAFLIIMIRNQFAHNQLPAVQFFEFIQKKYPEIQGSTTSELYLNFINLAVVELLELLEK

SEQ ID NO: 365 - protein, 1036 aa, Chryseobacterium ureilyticum
METQILGNGISYDHTKTEDKHFFGGFLNTAQNNIDLLIKAYISKFESSPRKLNSVQFPDVCFKKNDSDADFQHKLQFIRKHLPVIQYLKYGGNREVLKEKFRLLLQAVDSLRNFYTHFYHKPIQLPNELLTLLDTIFGEIGNEVRQNKMKDDKTRHLLKKNLSEELDFRYQEQLERLRKLKSEGKKVDLRDTEAIRNGVLNAAFNHLIFKDAEDFKPTVSYSSYYYDSDTAENGISISQSGLLFLLSMFLGRREMEDLKSRVRGFKARIIKHEEQHVSGLKFMATHWVFSEFCFKGIKTRLNADYHEETLLIQLIDELSKVPDELYRSFDVATRERFIEDINEYIRDGKEDKSLIESKIVHPVIRKRYESKFNYFAIRFLDEFVNFPTLRFQVHAGNYVHDRRIKSIEGTGFKTERLVKDRIKVFGKLSTISSLKAEYLAKAVNITDDTGWELLPHPSYVFIDNNIPIHLTVDPSFKNGVKEYQEKRKLQKPEEMKNRQGGDKMHKPAISSKIGKSKDINPESPVALLSMNEIPALLYEILVKKASPEEVEAKIRQKLTAVFERIRDYDPKVPLPASQVSKRLRNNTDTLSYNKEKLVELANKEVEQTERKLALITKNRRECREKVKGKFKRQKVFKNAELGTEATWLANDIKRFMPEEQKKNWKGYQHSQLQQSLAFFESRPGEARSLLQAGWDFSDGSSFWNGWVMNSFARDNTFDGFYESYLNGRMKYFLRLADNIAQQSSTNKLISNFIKQQMPKGLFDRRLYMLEDLATEKNKILSKPLIFPRGIFDDKPTFKKGVQVSEEPEAFADWYSYGYDVKHKFQEFYAWDRDYEELLREELEKDTAFTKNSIHYSRESQIELLAKKQDLKVKKVRIQDLYLKLMAEFLFENVFGHELALPLDQFYLTQEERLKQEQEAIVQSQRPKGDDSPNIVKENFIWSKTIPFKSGRVFEPNVKLKDIGKFRNLLTDEKVDILLSYNNTEIGKQVIENELIIGAGSYEFIRREQLFKEIQQMKRLSLRSVRGMGVPIRLNLK

SEQ ID NO: 366 - protein, 1127 aa, Prevotella buccae
MQKQDKLFVDRKKNAIFAFPKYITIMENQEKPEPIYYELTDKHFWAAFLNLARHNVYTTINHINRRLEIAELKDDGYMMDIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAQQNQPEVWRKLVKDLDYFEASQEPYIPKTAPHYHLENEKIGIKFCSTHNNLFPSLKTEKTCNGRSKFNLGTQFTAEAFLSVHELLPMMFYYLLLTKDYSRKESADKVEGIIRKEISNIYAIYDAFANGEINSIADLTCRLQKTNILQGHLPKQMISILEGRQKDMEKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDHELIKYQTTRISIFEMTLGLEKKLINKYPTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 367 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHNLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 368 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 369 - protein, 1125 aa, Prevotella pallens; identical to SEQ ID NO: 351

SEQ ID NO: 370 - protein, 1157 aa, Myroides odoratimimus; identical to SEQ ID NO: 352

SEQ ID NO: 371 - protein, 1157 aa, Myroides odoratimimus; identical to SEQ ID NO: 353

SEQ ID NO: 372 - protein, 1127 aa, Prevotella sp. MSX73
MQKQDKLFVDRKKNAIFAFPKYITIMENQEKPEPIYYELTDKHFWAAFLNLARHNVYTTINHINRRLEIAELKDDGYMMGIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSTHNNLFPSLKREKTCNGRSKFNLGTQFTAEAFLSVHELLPMMFYYLLLTKDYSRKESADKVEGIIRKEISNIYAIYDAFANNEINSIADLTCRLQKTNILQGHLPKQMISILEGRQKDMEKEAERKIGEMIDDTQRRLDLLCKQTNQKIRIGKRNAGLLKSGKIADWLVSDMMRFQPVQKDTNNAPINNSKANSTEYRMLQHALALFGSESSRLKAYFRQMNLVGNANPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKNKTDLAYLDFLSWKKFERELRLIKNQDIVTWLMFKELFKTTTVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDYELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 373 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEINTRDELDACLADKGIRRGHLPRQMIGILSQEHKDMEEKVRKKLQEMIVDTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMICRDLMEENKVEGLDTGTLYLKDIRTDVQEQGNLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDEAVFSSIRKYDPSSPDAIEERMGLNIAHRLSEEVKQAKEMAERIIQA

SEQ ID NO: 374 - protein, 1154 aa, Paludibacter propionicigenes
MKTSANNIYFNGINSFKKIFDSKGAIAPIAEKSCRNFDIKAQNDVNKEQRIHYFAVGHTFKQLDTENLFEYVLDENLRAKRPTRFISLQQFDKEFIENIKRLISDIRNINSHYIHRFDPLKIDAVPTNIIDFLKESFELAVIQIYLKEKGINYLQFSENPHADQKLVAFLHDKFLPLDEKKTSMLQNETPQLKEYKEYRKYFKTLSKQAAIDQLLFAEKETDYIWNLFDSHPVLTISAGKYLSFYSCLFLLSMFLYKSEANQLISKIKGFKKNTTEEEKSKREIFTFFSKRFNSMDIDSEENQLVKFRDLILYLNHYPVAWNKDLELDSSNPAMTDKLKSKIIELEINRSFPLYEGNERFATFAKYQIWGKKHLGKSIEKEYINASFTDEEITAYTYETDTCPELKDAHKKLADLKAAKGLFGKRKEKNESDIKKTETSIRELQHEPNPIKDKLIQRIEKNLLTVSYGRNQDRFMDFSARFLAEINYFGQDASFKMYHFYATDEQNSELEKYELPKDKKKYDSLKFHQGKLVHFISYKEHLKRYESWDDAFVIENNAIQLKLSFDGVENTVTIQRALLIYLLEDALRNIQNNTAENAGKQLLQEYYSHNKADLSAFKQILTQQDSIEPQQKTEFKKLLPRRLLNNYSPAINHLQTPHSSLPLILEKALLAEKRYCSLVVKAKAEGNYDDFIKRNKGKQFKLQFIRKAWNLMYFRNSYLQNVQAAGHHKSFHIERDEFNDFSRYMFAFEELSQYKYYLNEMFEKKGFFENNEFKILFQSGTSLENLYEKTKQKFEIWLASNTAKTNKPDNYHLNNYEQQFSNQLFFINLSHFINYLKSTGKLQTDANGQIIYEALNNVQYLIPEYYYTDKPERSESKSGNKLYNKLKATKLEDALLYEMAMCYLKADKQIADKAKHPITKLLTSDVEFNITNKEGIQLYHLLVPFKKIDAFIGLKMHKEQQDKKHPTSFLANIVNYLELVKNDKDIRKTYEAFSTNPVKRTLTYDDLAKIDGHLISKSIKFTNVTLELERYFIFKESLIVKKGNNIDFKYIKGLRNYYNNEKKKNEGIRNKAFHFGIPDSKSYDQLIRDAEVMFIANEVKPTHATKYTDLNKQLHTVCDKLMETVHNDYFSKEGDGKKKREAAGQKYFENIISAK

SEQ ID NO: 375 - protein, 1119 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKNKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEEDTDGAEEDPFKNTLVRHQDRFPYFALRYFDLKKVFTSLRFQIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRFTAEAFLSAHELMPMMFYYFLLREKYSEEASAERVQGRIKRVIEDVYAVYDAFARDEINTRDELDACLADKGIRRGHLPRQMIGILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDWVQPFYNYPFNVGNSLKPKKGRFLSKEKRAEEWESGKERFRLAKLKKEILEAKEHPYLDFKSWQKFERELRLVKNQDIITWMICGDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSFPDAIEERMGLNIAHRLSEEVKQAKETVERIIQA

SEQ ID NO: 376 - protein, 1179 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNAIQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLNTESTFLENGLIGLPPKILKKELSKRFKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKRNDSSLWNKVIHLSLQNNRITANPKLKDIGKYKRALQDEKIATLLTYDDRTWTYALQKPEKENENDYKELHYTALNMELQEYEKVRSKELLKQVQELEKQILEEYTDFLSTQIHPADFEREGNPNFKKYLAHSILENEDDLDKLPEKVEAMRELDETITNPIIKKAIVLIIIRNKMAHNQYPPKFIYDLANRFVPKKEEEYFATYFNRVFETITKELWENKEKKDKTQV

SEQ ID NO: 377 - protein, 1145 aa, Psychroflexus torquis
MESIIGLGLSFNPYKTADKHYFGSFLNLVENNLNAVFAEFKERISYKAKDENISSLIEKHFIDNMSIVDYEKKISILNGYLPIIDFLDDELENNLNTRVKNFKKNFIILAEAIEKLRDYYTHFYHDPITFEDNKEPLLELLDEVLLKTILDVKKKYLKTDKTKEILKDSLREEMDLLVIRKTDELREKKKTNPKIQHTDSSQIKNSIFNDAFQGLLYEDKGNNKKTQVSHRAKTRLNPKDIHKQEERDFEIPLSTSGLVFLMSLFLSKKEIEDFKSNIKGFKGKVVKDENHNSLKYMATHRVYSILAFKGLKYRIKTDTFSKETLMMQMIDELSKVPDCVYQNLSETKQKDFIEDWNEYFKDNEENTENLENSRVVHPVIRKRYEDKFNYFAIRFLDEFANFKTLKFQVFMGYYIHDQRTKTIGTTNITTERTVKEKINVFGKLSKMDNLKKHFFSQLSDDENTDWEFFPNPSYNFLTQADNSPANNIPIYLELKNQQIIKEKDAIKAEVNQTQNRNPNKPSKRDLLNKILKTYEDFHQGDPTAILSLNEIPALLHLFLVKPNNKTGQQIENIIRIKIEKQFKAINHPSKNNKGIPKSLFADTNVRVNAIKLKKDLEAELDMLNKKHIAFKENQKASSNYDKLLKEHQFTPKNKRPELRKYVFYKSEKGEEATWLANDIKRFMPKDFKTKWKGCQHSELQRKLAFYDRHTKQDIKELLSGCEFDHSLLDINAYFQKDNFEDFFSKYLENRIETLEGVLKKLHDFKNEPTPLKGVFKNCFKFLKRQNYVTESPEIIKKRILAKPTFLPRGVFDERPTMKKGKNPLKDKNEFAEWFVEYLENKDYQKFYNAEEYRMRDADFKKNAVIKKQKLKDFYTLQMVNYLLKEVFGKDEMNLQLSELFQTRQERLKLQGIAKKQMNKETGDSSENTRNQTYIWNKDVPVSFFNGKVTIDKVKLKNIGKYKRYERDERVKTFIGYEVDEKWMMYLPHNWKDRYSVKPINVIDLQIQEYEEIRSHELLKEIQNLEQYIYDHTTDKNILLQDGNPNFKMYVLNGLLIGIKQVNIPDFIVLKQNTNFDKIDFTGIASCSELEKKTIILIAIRNKFAHNQLPNKMIYDLANEFLKIEKNETYANYYLKVLKKMISDLA

SEQ ID NO: 378 - protein, 948 aa, Riemerella anatispestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRRLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLKVLREYCEIVKSQI

SEQ ID NO: 379 - protein, 1139 aa, Prevotella pleuritidis
MENDKRLEESACYTLNDKHFWAAFLNLARHNVYITVNHINKTLELKNKKNQEIIIDNDQDILAIKTHWAKVNGDLNKTDRLRELMIKHFPFLEAAIYSNNKEDKEEVKEEKQAKAQSFKSLKDCLFLFLEKLQEARNYYSHYKYSESSKEPEFEEGLLEKMYNTFDASIRLVKEDYQYNKDIDPEKDFKHLERKEDFNYLFTDKDNKGKITKNGLLFFVSLFLEKKDAIWMQQKFRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGGKKEDRHLTHKLYGFERIQEFTKQNRPDKWQAIIKDLDTYETSNERYISETTPHYHLENQKIGIRFRNDNNDIWPSLKTNGEKNEKSKYNLDKPYQAEAFLSVHELLPMMFYYLLLKMENTDNDKEDNEVGTKKKGNKNNKQEKHKIEEIIENKIKDIYALYDAFTNGEINSIDELAEQREGKDIEIGHLPKQLIVILKNKSKDMAEKANRKQKEMIKDTKKRLATLDKQVKGEIEDGGRNIRLLKSGEIARWLVNDMMRFQPVQKDNEGKPLNNSKANSTEYQMLQRSLALYNKEEKPTRYFRQVNLIKSSNPHPFLEDTKWEECYNILSFYRNYLKAKIKFLNKLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDILTWLLCTKLIDKLKIDELNIEELQKLRLKDIDTDTAKKEKNNILNRVMPMRLPVTVYEIDKSFNIVKDKPLHTVYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVGLLVAVRNAFSHNQYPMYNSEVFKGMKLLSLSSDIPEKEGLGIAKQLKDKIKETIERIIEIEKEIRN

SEQ ID NO: 380 - protein, 1135 aa, Porphyromonas gingivalis; identical to SEQ ID NO: 358

SEQ ID NO: 381 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTNENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 382 - protein, 1135 aa, Porphyromonas gingivalis; identical to SEQ ID NO: 359

SEQ ID NO: 383 - protein, 1135 aa, Porphyromonas gingivalis; identical to SEQ ID NO: 360

SEQ ID NO: 384 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 385 - protein, 1133 aa, Prevotella falsenii
MKNDNNSTKSTDYTLGDKHFWAAFLNLARHNVYITVNHINKVLELKNKKDQEIIIDNDQDILAIKTLWGKVDTDINKKDRLRELIMKHFPFLEAATYQQSSTNNTKQKEEEQAKAQSFESLKDCLFLFLEKLREARNYYSHYKHSKSLEEPKLEEKLLENMYNIFDTNVQLVIKDYEHNKDINPEEDFKHLGRAEGEFNYYFTRNKKGNITESGLLFFVSLFLEKKDAIWAQTKIKGFKDNRENKQKMTHEVFCRSRMLLPKLRLESTQTQDWILLDMLNELIRCPKSLYKRLQGEKREKFRVPFDPADEDYDAEQEPFKNTLVRHQDRFPYFALRYFDYNEIFTNLRFQIDLGTYHFSIYKKQIGDKKEDRHLTHKLYGFERIQEFAKENRPDEWKALVKDLDTFEESNEPYISETTPHYHLENQKIGIRNKNKKKKKTIWPSLETKTTVNERSKYNLGKSFKAEAFLSVHELLPMMFYYLLLNKEEPNNGKINASKVEGIIEKKIRDIYKLYGAFANEEINNEEELKEYCEGKDIAIRHLPKQMIAILKNEYKDMAKKAEDKQKKMIKDTKKRLAALDKQVKGEVEDGGRNIKPLKSGRIASWLVNDMMRFQPVQRDRDGYPLNNSKANSTEYQLLQRTLALFGSERERLAPYFRQMNLIGKDNPHPFLKDTKWKEHNNILSFYRSYLEAKKNFLGSLKPEDWKKNQYFLKLKEPKTNRETLVQGWKNGFNLPRGIFTEPIREWFIRHQNESEEYKKVKDFDRIGLVAKVIPLFFKEDYQKEIEDYVQPFYGYPFNVGNIHNSQEGTFLNKKEREELWKGNKTKFKDYKTKEKNKEKTNKDKFKKKTDEEKEEFRSYLDFQSWKKFERELRLVRNQDIVTWLLCMELIDKLKIDELNIEELQKLRLKDIDTDTAKKEKNNILNRIMPMELPVTVYETDDSNNIIKDKPLHTIYIKEAETKLLKQGNFKALVKDRRLNGLFSFVETSSEAELKSKPISKSLVEYELGEYQRARVEIIKDMLRLEETLIGNDEKLPTNKFRQMLDKWLEHKKETDDTDLKNDVKLLTEVRNAFSHNQYPMRDRIAFANIKPFSLSSANTSNEEGLGIAKKLKDKTKETIDRIIEIEEQTATKR

SEQ ID NO: 386 - protein, 1116 aa, Prevotella pleuritidis
MENDKRLEESTCYTLNDKHFWAAFLNLARHNVYITINHINKLLEIRQIDNDEKVLDIKALWQKVDKDINQKARLRELMIKHFPFLEAAIYSNNKEDKEEVKEEKQAKAQSFKSLKDCLFLFLEKLQEARNYYSHYKSSESSKEPEFEEGLLEKMYNTFGVSIRLVKEDYQYNKDIDPEKDFKHLERKEDFNYLFTDKDNKGKITKNGLLFFVSLFLEKKDAIWMQQKLRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGDNKEDRHLTHKLYGFERIQEFAKQKRPNEWQALVKDLDIYETSNEQYISETTPHYHLENQKIGIRFKNKKDKIWPSLETNGKENEKSKYNLDKSFQAEAFLSIHELLPMMFYDLLLKKEEPNNDEKNASIVEGFIKKEIKRMYAIYDAFANEEINSKEGLEEYCKNKGFQERHLPKQMIAILTNKSKNMAEKAKRKQKEMIKDTKKRLATLDKQVKGEIEDGGRNIRLLKSGEIARWLVNDMMRFQSVQKDKEGKPLNNSKANSTEYQMLQRSLALYNKEQKPTPYFIQVNLIKSSNPHPFLEETKWEECNNILSFYRSYLEAKKNFLESLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDIVTWLLCTELIDKLKIDELNIEELQKLRLKDIDTDTAKKEKNNILNRIMPMQLPVTVYEIDKSFNIVKDKPLHTIYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVDLLVAIRNAFSHNQYPMYNSEVFKGMKLLSLSSDIPEKEGLGIAKQLKDKIKETIERIIEIEKEIRN

SEQ ID NO: 387 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPIDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQV

SEQ ID NO: 388 - protein, 1175 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKNMEEKVRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHDTRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRTNVQEQGSLNVLNHVKPMRLPVVVYRADSRGHVHKEEAPLATVYIEERDTKLLKQGNFKSFVKDRRLNGLFSFVDTGGLAMEQYPISKLRVEYELAKYQTARVCAFEQTLELEESLLTRYPHLPDKNFRKMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 389 - protein, 1119 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKVIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTRDELDACLADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKTDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 390 - protein, 1119 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIKDVYAIYDAFARDEINTLKELDACSADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKNDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDENFREMLESWSDPLLGKWPDLHGKVRLLIAVRNAFSHNQYPMYDEAVFSSIRKYDPSSPDAIEERMGLNIAHRLSEEVKQAKETVERIIQA

SEQ ID NO: 391 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 392 - protein, 1119 aa, Poprhyromonas gulae
MTEQSERPYNGTYYTLEDKHFWAAFLNLARHNAYITLTHIDRQLAYSKADITNDEDILFFKGQWKNLDNDLERKSRLRSLILKHFSFLEGAAYGKKFFESKSSGNKSSKNKELTKKEKEELQANALSLDNLKSILFDFLQKLKDFRNYYSHYRHSGSSELPLFDGNMLQRLYNVFDVSVQRVKRDHEHNDEVDPHYHFNHLVRKGKKDRYGHNDNPSFKHHFVDGEGMVTEAGLLFFVSLFLEKRDAIWMQKKIRGFKGGTEPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLTKWPELHGKVRLLIAVRNAFSHNQYPMYDEAVFSSIWKYDPSSPDAIEERMGLNIAHRLSEEVKQAKETIERIIQA

SEQ ID NO: 393 - protein, 1174 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYLETGDKPYISQTTPHYHIEKGKIGLRFVPEGQHLWPSPEVGTTRTGRSKCAQDKRLTAEAFLSVHELMPMMFYYFLLREKYSEEVSAEKVQGRIKRVIEDVYAIYDAFARDEINTLKELDTCLADKGIRRGHLPKQMITILSQERKDMKEKIRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKDEFHLPRGIFTEAVRDCLIEMGYDEVGSYREVGFMAKAVPLYFERACEDRVQPFYDSPFNVGNSLKPKKGRFLSKEDRAEEWERGMERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEAPLATVYIEERNTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 394 - protein, 1135 aa, Porphyromonas gulae
MNTVPATENKGQSRTVEDDPQYFGLYLNLARENLIEVESHVRIKFGKKKLNEESLKQSLLCDHLLSIDRWTKVYGHSRRYLPFLHCFDPDSGIEKDHDSKTGVDPDSAQRLIRELYSLLDFLRNDFSHNRLDGTTFEHLKVSPDISSFITGAYTFACERAQSRFADFFKPDDFLLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 395 - protein, 1218 aa, Capnocytophaga cynodegmi
MENKTSLGNNIYYNPFKPQDKSYFAGYLNAAMENIDSVFRELGKRLKGKEYTSENFFDAIFKENISLVEYERYVKLLSDYFPMARLLDKKEVPIKERKENFKKNFRGIIKAVRDLRNFYTHKEHGEVEITDEIFGVLDEMLKSTVLTVKKKKIKTDKTKEILKKSIEKQLDILCQKKLEYLKDTARKIEEKRRNQRERGEKKLVPRFEYSDRRDDLIAAIYNDAFDVYIDKKKDSLKESSKTKYNTESYPQQEEGDLKIPISKNGVVFLLSLFLSKQEVHAFKSKIAGFKATVIDEATVSHRKNSICFMATHEIFSHLAYKKLKRKVRTAEINYSEAENAEQLSIYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKEHLISDRRIKEKITVFGRLSELEHKKALFIKNTETNEDRKHYWEVFPNPNYDFPKENISVNDKDFPIAGSILDREKQPTAGKIGIKVNLLNQKYISEVDKAVKAHQLKQRNNKPSIQNIIEEIVPINGSNPKEIIVFGGQPTAYLSMNDIHSILYEFFDKWEKKKEKLEKKGEKELRKEIGKELEEKIVGKIQTQIQQIIDKDINAKILKPYQDDDSTAIDKEKLIKDLKQEQKILQKLKNEQTAREKEYQECIAYQEESRKIKRSDKSRQKYLRNQLKRKYPEVPTRKEILYYQEKGKVAVWLANDIKRFMPTDFKNEWKGEQHSLLQKSLAYYEQCKEELKNLLPQQKVFKHLPFELGGHFQQKYLYQFYTRYLDKRLEHISGLVQQAENFKNENKVFKKVENECFKFLKKQNYTHKGLDAQAQSVLGYPIFLERGFMDEKPTIIKGKTFKGNESLFTDWFRYYKEYQNFQTFYDTENYPLVELEKKQADRKRETKIYQQKKNDVFTLLMAKHIFKSVFKQDSIDRFSLEDLYQSREERLENQEKAKQTGERNTNYIWNKTVDLNLCDGKVTVENVKLKNVGNFIKYEYDQRVQTFLKYEENIKWQAFLIKESKEEENYPYIVEREIEQYEKVRREELLKEVHLIEEYILEKVKDKEILKKGDNQNFKYYILNGLLKQLKNEDVESYKVFNLNTKPEDVNINQLKQEATDLEQKAFVLTYIRNKFAHNQLPKKEFWDYCQEKYGKIEKEKTYAEYFAEVFKREKEALMK

SEQ ID NO: 396 - protein, 1090 aa, Prevotella sp. P5-119
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPLSGMISKYYTVALRNTKERYGYKTEDLAFIQDNIKKITKDAYGKRKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSTDRFVPLLLQYIDYGKLFDHIRFHVNMGKLRYLLKADKTCIDGQTRVRVIEQPLNGFGRLEEAETMRKQENGTFGNSGIRIRDFENVKRDDANPANYPYIVDTYTHYILENNKVEMFISDKGSSAPLLPLIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVDFYERYLIERKFYLTGLCNEIKRGNRVDVPFIRRDQNKWKTPAMKTLGRIYSEDLPVELPRQMFDNEIKSHLKSLPQMEGIDFNNANVTYLIAEYMKRVLNDDFQTFYQWKRNYHYMDMLKGEYDRKGSLQHCFTSVEEREGLWKERASRTERYRKLASNKIRSNRQMRNASSEEIETILDKRLSNCRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGIVEIKALPEIAMSIKKAFGEYAIMK

SEQ ID NO: 397 - protein, 1090 aa, Prevotella sp. P4-76
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDQASHYKTYDEKLIDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKQPKDRIHSEKSNKSVAMDMLNEIKRCPNELFETLSAEKQSRFRIISNDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVDTYTHYILENNKVEMFISDEETPAPLLPVIEDDRYVVKTIPSCRMSTLEIPAMAFHMFLFGSKKTEKLIVDVHNRYKRLFKAMQKEEVTAENIASFGIAESDLPQKIIDLISGNAHGKDVDAFIRLTVDDMLADTERRIKRFKDDRKSIRSADNKMGKRGFKQISTGKLADFLAKDIVLFQPSVNDGENKITGLNYRIMQSAIAVYNSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYDEDLPVELPRQMFDNEIKSHLKSLPQMEGIDFNNANVTYLIAEYMKRVLNDDFQTFYQWKRNYRYMDMLRGEYDRKGSLQSCFTSVEEREGLWKERASRTERYRKLASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDTVSKEDIMEEFKKYDQCRPEISSIVFNLEKWAFDTYPELSARVDREEKVDFKSILKILLNNKNINKEQSDILRKIRNAFDHNNYPDKGVVEIRALPEIAMSIKKAFGEYAIMK

SEQ ID NO: 398 - protein, 1090 aa, Prevotella sp. P5-60
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPFSGMISKYYTVALRNTKERYGYKAEDLAFIQDNRYKFTKDAYGKRKSQVNTGSFLSLQDYNGDTTKKLHLSGVGIALLICLFLDKQYINLFLSRLPIFSSYNAQSEERRIIIRSFGINSIKQPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVETYTHYILENNKVEMFISDEENPTPLLPVIEDDRYVVKTIPSCRMSTLEIPAMAFHMFLFGSEKTEKLIIDVHDRYKRLFQAMQKEEVTAENIASFGIAESDLPQKIMDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYSEDLPVELPRQMFDNEIKSHLKSLPQMEGIDFNNANVTYLIAEYMKRVLNDDFQTFYQWKRNYRYMDMLRGEYDRKGSLQHCFTSIEEREGLWKERASRTERYRKLASNKIRSNRQMRNASSEEIETILDKRLSNCRNEYQKSEKIIRRYRVQDALLFLLAKKTLTELADFDGERFKLKEIMPDAEKGILSEIMPMSFTFEKGGKIYTITSGGMKLKNYGDFFVLASDKRIGNLLELVGSNTVSKEDIMEEFKKYDQCRPEISSIVFNLEKWAFDTYPELPARVDRKEKVDFWSILDVLSNNKDINNEQSYILRKIRNAFDHNNYPDKGIVEIKALPEIAMSIKKAFGEYAIMK

SEQ ID NO: 399 - protein, 1131 aa, Phaeodactylibacter xiamenensis
MTNTPKRRTLHRHPSYFGAFLNIARHNAFMIMEHLSTKYDMEDKNTLDEAQLPNAKLFGCLKKRYGKPDVTEGVSRDLRRYFPFLNYPLFLHLEKQQNAEQAATYDINPEDIEFTLKGFFRLLNQMRNNYSHYISNTDYGKFDKLPVQDIYEAAIFRLLDRGKHTKRFDVFESKHTRHLESNNSEYRPRSLANSPDHENTVAFVTCLFLERKYAFPFLSRLDCFRSTNDAAEGDPLIRKASHECYTMFCCRLPQPKLESSDILLDMVNELGRCPSALYNLLSEEDQARFHIKREEITGFEEDPDEELEQEIVLKRHSDRFPYFALRYFDDTEAFQTLRFDVYLGRWRTKPVYKKRIYGQERDRVLTQSIRTFTRLSRLLPIYENVKHDAVRQNEEDGKLVNPDVTSQFHKSWIQIESDDRAFLSDRIEHFSPHYNFGDQVIGLKFINPDRYAAIQNVFPKLPGEEKKDKDAKLVNETADAIISTHEIRSLFLYHYLSKKPISAGDERRFIQVDTETFIKQYIDTIKLFFEDIKSGELQPIADPPNYQKNEPLPYVRGDKEKTQEERAQYRERQKEIKERRKELNTLLQNRYGLSIQYIPSRLREYLLGYKKVPYEKLALQKLRAQRKEVKKRIKDIEKMRTPRVGEQATWLAEDIVFLTPPKMHTPERKTTKHPQKLNNDQFRIMQSSLAYFSVNKKAIKKFFQKETGIGLSNRETSHPFLYRIDVGRCRGILDFYTGYLKYKMDWLDDAIKKVDNRKHGKKEAKKYEKYLPSSIQHKTPLELDYTRLPVYLPRGLFKKAIVKALAAHADFQVEPEEDNVIFCLDQLLDGDTQDFYNWQRYYRSALTEKETDNQLVLAHPYAEQILGTIKTLEGKQKNNKLGNKAKQKIKDELIDLKRAKRRLLDREQYLRAVQAEDRALWLMIQERQKQKAEHEEIAFDQLDLKNITKILTESIDARLRIPDTKVDITDKLPLRRYGDLRRVAKDRRLVNLASYYHVAGLSEIPYDLVKKELEEYDRRRVAFFEHVYQFEKEVYDRYAAELRNENPKGESTYFSHWEYVAVAVKHSADTHFNELFKEKVMQLRNKFHHNEFPYFDWLLPEVEKASAALYADRVFDVAEGYYQKMRKLMRQ

SEQ ID NO: 400 - protein, 1155 aa, Flavobacterium sp. 316
MDNNITVEKTELGLGITYNHDKVEDKHYFGGFFNLAQNNIDLVAQEFKKRLLIQGKDSINIFANYFSDQCSITNLERGIKILAEYFPVVSYIDLDEKNKSKSIREHLILLLETINNLRNYYTHYYHKKIIIDGSLFPLLDTILLKVVLEIKKKKLKEDKTKQLLKKGLEKEMTILFNLMKAEQKEKKIKGWNIDENIKGAVLNRAFSHLLYNDELSDYRKSKYNTEDETLKDTLTESGILFLLSFFLNKKEQEQLKANIKGYKGKIASIPDEEITLKNNSLRNMATHWTYSHLTYKGLKHRIKTDHEKETLLVNMVDYLSKVPHEIYQNLSEQNKSLFLEDINEYMRDNEENHDSSEASRVIHPVIRKRYENKFAYFAIRFLDEFAEFPTLRFMVNVGNYIHDNRKKDIGGTSLITNRTIKQQINVFGNLTEIHKKKNDYFEKEENKEKTLEWELFPNPSYHFQKENIPIFIDLEKSKETNDLAKEYAKEKKKIFGSSRKKQQNTAKKNRETIINLVFDKYKTSDRKTVTFEQPTALLSFNELNSFLYAFLVENKTGKELEKIIIEKIANQYQILKNCSSTVDKTNDNIPKSIKKIVNTTTDSFYFEGKKIDIEKLEKDITIEIEKTNEKLETIKENEESAQNYKRNERNTQKRKLYRKYVFFTNEIGIEATWITNDILRFLDNKENWKGYQHSELQKFISQYDNYKKEALGLLESEWNLESDAFFGQNLKRMFQSNSTFETFYKKYLDNRKNTLETYLSAIENLKTMTDVRPKVLKKKWTELFRFFDKKIYLLSTIETKINELITKPINLSRGIFEEKPTFINGKNPNKENNQHLFANWFIYAKKQTILQDFYNLPLEQPKAITNLKKHKYKLERSINNLKIEDIYIKQMVDFLYQKLFEQSFIGSLQDLYTSKEKREIEKGKAKNEQTPDESFIWKKQVEINTHNGRIIAKTKIKDIGKFKNLLTDNKIAHLISYDDRIWDFSLNNDGDITKKLYSINTELESYETIRREKLLKQIQQFEQFLLEQETEYSAERKHPEKFEKDCNPNFKKYIIEGVLNKIIPNHEIEEIEILKSKEDVFKINFSDILILNNDNIKKGYLLIMIRNKFAHNQLIDKNLFNFSLQLYSKNENENFSEYLNKVCQNIIQEFKEKLK

SEQ ID NO: 401 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 402 - protein, 1145 aa, Chryseobacterium sp. YR477
METQTIGHGIAYDHSKIQDKHFFGGFLNLAENNIKAVLKAFSEKFNVGNVDVKQFADVSLKDNLPDNDFQKRVSFLKMYFPVVDFINIPNNRAKFRSDLTTLFKSVDQLRNFYTHYYHKPLDFDASLFILLDDIFARTAKEVRDQKMKDDKTRQLLSKSLSEELQKGYELQLERLKELNRLGKKVNIHDQLGIKNGVLNNAFNHLIYKDGESFKTKLTYSSALTSFESAENGIEISQSGLLFLLSMFLKRKEIEDLKNRNKGFKAKVVIDEDGKVNGLKFMATHWVFSYLCFKGLKSKLSTEFHEETLLIQIIDELSKVPDELYCAFDKETRDKFIEDINEYVKEGHQDFSLEDAKVIHPVIRKRYENKFNYFAIRFLDEFVKFPSLRFQVHVGNYVHDRRIKNIDGTTFETERVVKDRIKVFGRLSEISSYKAQYLSSVSDKHDETGWEIFPNPSYVFINNNIPIHISVDTSFKKEIADFKKLRRAQVPDELKIRGAEKKRKFEITQMIGSKSVLNQEEPIALLSLNEIPALLYEILINGKEPAEIERIIKDKLNERQDVIKNYNPENWLPASQISRRLRSNKGERIINTDKLLQLVTKELLVTEQKLKIISDNREALKQKKEGKYIRKFIFTNSELGREAIWLADDIKRFMPADVRKEWKGYQHSQLQQSLAFYNSRPKEALAILESSWNLKDEKIIWNEWILKSFTQNKFFDAFYNEYLKGRKKYFAFLSEHIVQYTSNAKNLQKFIKQQMPKDLFEKRHYIIEDLQTEKNKILSKPFIFPRGIFDKKPTFIKGVKVEDSPESFANWYQYGYQKDHQFQKFYDWKRDYSDVFLEHLGKPFINNGDRRTLGMEELKERIIIKQDLKIKKIKIQDLFLRLIAENLFQKVFKYSAKLPLSDFYLTQEERMEKENMAALQNVREEGDKSPNIIKDNFIWSKMIPYKKGQIIENAVKLKDIGKLNVLSLDDKVQTLLSYDDAKPWSKIALENEFSIGENSYEVIRREKLFKEIQQFESEILFRSGWDGINHPAQLEDNRNPKFKMYIVNGILRKSAGLYSQGEDIWFEYNADFNNLDADVLETKSELVQLAFLVTAIRNKFAHNQLPAKEFYFYIRAKYGFADEPSVALVYLNFTKYAINEFKKVMI

SEQ ID NO: 403 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 404 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKLLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 405 - protein, 1175 aa, Porphyromonas gingivalis
MTEQNEKPYNGTYYTLKDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPMFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTETYQQMTNEVFCRSRISLPKLKLESLRTDDWMLLDMLNELVRCPKSLYDRLREEDRACFRVPVDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDCFETGDKPYITQTTPHYHIEKGKIGLRFVPEGQHLWPSPEVGATRTGRSKYAQDKRFTAEAFLSVHELMPMMFYYFLLREKYSEEVSAERVQGRIKRVIEDVYAVYDAFARDEINTRDELDACLADKGIRRGHLPRQMIAILSQKHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVQEQGSLNVLNHVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDENFRKMLESWSDPLLDKWPDLHRKVRLLIAVRNAFSHNQYPMYDEAVFSSIRKYDPSSPDAIEERMGLNIAHRLSEEVKQAKEMAERIIQA

SEQ ID NO: 406 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKVYDFLDDTLLDVLITIKKKKVKNDTSRELLKEKFRPELTQLKNQKREELIKKGKKLLEENLENAVFNHCLRPFLEENKTDDKQNKTVSLRKYRKSKPNEETSITLTQSGLVFLISFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLTKTISTDTSVTFENQPIDIPRLKNALQKELTLTQEKLLNVKQHEIEVDNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 407 - protein, 1119 aa, Porphyromonas gingivalis
MTEQNERPYNGTYYTLEDKHFWAAFFNLARHNAYITLTHIDRQLAYSKADITNDEDILFFKGQWKNLDNDLERKARLRSLILKHFSFLEGAAYGKKLFENKSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTEVQEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRCPHLPDKNFRKMLESWSDPLLDKWPDLQREVWLLIAVRNAFSHNQYPMYDEAVFSSIRKYDPSSPDAIEERMGLNIAHRLSEEVKQAKEMAERIIQA

SEQ ID NO: 408 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 409 - protein, 950 aa, Rimerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQSEKMTTEVFCRSRILLPKLRLESRYDHNQMLLDMLSELSRCPKLLYEKLSEKDKKCFQVEADGFLDEIEEEQNPFKDTLIRHQDRFPYFALRYLDLNESFKSIRFQVDLGTYHYCIYDKKIGYEQEKRHLTRTLLNFGRLQDFTEINRPQEWKALTKDLDYNETSNQPFISKTTPHYHITDNKIGFRLRTSKELYPSLEVKDGANRIAKYPYNSDFVAHAFISISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVVYDAQNQPIKSSKANSTESRLIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRHLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLRVLREYCEIVKSQI

SEQ ID NO: 410 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEKISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLNSPQKDNIPTTLIKTISTDTSVTFENQPIDIPRLKNAIQKELALTQEKLLNVKQHEIEVNNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 411 - protein, 1095 aa, Riemerella anatispestifer
MEKPLPPNVYTLKHKFFWGAFLNIARHNAFITICHINEQLGLTTPPNDDKIADVVCGTWNNILNNDHDLLKKSQLTELILKHFPFLAAMCYHPPKKEGKKKGSQKEQQKEKENEAQSQAEALNPSELIKVLKTLVKQLRTLRNYYSHHSHKKPDAEKDIFKHLYKAFDASLRMVKEDYKAHFTVNLTQDFAHLNRKGKNKQDNPDFDRYRFEKDGFFTESGLLFFTNLFLDKRDAYWMLKKVSGFKASHKQSEKMTTEVFCRSRILLPKLRLESRYDHNQMLLDMLSELSRYPKLLYEKLSEEDKKRFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSKQPFISKTTPHYHITDNKIGFRLGTSKELYPSLEVKDGANRIAQYPYNSDFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIESSKANSTEFQLIQRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSKDLTLSKPIRKEIKKHGRVGFISRAITLYFREKYQDDHQSFYDLPYKLEAKASPLPKKEHYEYWQQNKPQSPTELQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYQETPIRTVYIREEQTKALKMGNFKALVKDRRLNGLFSFIKEENDTQKHPISQLRLRRELEIYQSLRVDAFKETLNLEEKLLKKHTSLSSVENKFRILLEEWKKEYAASSMVTDEHIAFIASVRNAFCHNQYPFYEEALHAPIPLFTVAQQTTEEKDGLGIAEALLRVLREYCEIVKSQI

SEQ ID NO: 412 - protein, 1149 aa, Sinomicrobium oceani
MESTTTLGLHLKYQHDLFEDKHYFGGGVNLAVQNIESIFQAFAERYGIQNPLRKNGVPAINNIFHDNISISNYKEYLKFLKQYLPVVGFLEKSNEINIFEFREDFEILINAIYKLRHFYTHYYHSPIKLEDRFYTCLNELFVAVAIQVKKHKMKSDKTRQLLNKNLHQLLQQLIEQKREKLKDKKAEGEKVSLDTKSIENAVLNDAFVHLLDKDENIRLNYSSRLSEDIITKNGITLSISGLLFLLSLFLQRKEAEDLRSRIEGFKGKGNELRFMATHWVFSYLNVKRIKHRLNTDFQKETLLIQIADELSKVPDEVYKTLDHENRSKFLEDINEYIREGNEDASLNESTVVHGVIRKRYENKFHYLVLRYLDEFVDFPSLRFQVHLGNYIHDRRDKVIDGTNFITNRVIKEPIKVFGKLSHVSKLKSDYMESLSREHKNGWDVFPNPSYNFVGHNIPIFINLRSASSKGKELYRDLMKIKSEKKKKSREEGIPMERRDGKPTKIEISNQIDRNIKDNNFKDIYPGEPLAMLSLNELPALLFELLRRPSITPQDIEDRMVEKLYERFQIIRDYKPGDGLSTSKISKKLRKADNSTRLDGKKLLRAIQTETRNAREKLHTLEENKALQKNRKRRTVYTTREQGREASWLAQDLKRFMPIASRKEWRGYHHSQLQQILAFYDQNPKQPLELLEQFWDLKEDTYVWNSWIHKSLSQHNGFVPMYEGYLKGRLGYYKKLESDIIGFLEEHKVLKRYYTQQHLNVIFRERLYFIKTETKQKLELLARPLVFPRGIFDDKPTFVQDKKVVDHPELFADWYVYSYKDDHSFQEFYHYKRDYNEIFETELSWDIDFKDNKRQLNPSEQMDLFRMKWDLKIKKIKIQDIFLKIVAEDIYLKIFGHKIPLSLSDFYISRQERLTLDEQAVAQSMRLPGDTSENQIKESNLWQTTVPYEKEQIREPKIKLKDIGKFKYFLQQQKVLNLLKYDPQHVWTKAELEEELYIGKHSYEVVRREMLLQKCHQLEKHILEQFRFDGSNHPRELEQGNHPNFKMYIVNGILTKRGELEIEAENWWLELGNSKNSLDKVEVELLTMKTIPEQKAFLLILIRNKFAHNQLPADNYFHYASNLMNLKKSDTYSLFWFTVADTIVQEFMSL

SEQ ID NO: 413 - protein, 1133 aa, Richenbachiella agariperforans
MKTNPLIASSGEKPNYKKFNTESDKSFKKIFQNKGSIAPIAEKACKNFEIKSKSPVNRDGRLHYFSVGHAFKNIDSKNVFRYELDESQMDMKPTQFLALQKEFFDFQGALNGLLKHIRNVNSHYVHTFEKLEIQSINQKLITFLIEAFELAVIHSYLNEEELSYEAYKDDPQSGQKLVQFLCDKFYPNKEHEVEERKTILAKNKRQALEHLLFIEVTSDIDWKLFEKHKVFTISNGKYLSFHACLFLLSLFLYKSEANQLISKIKGFKRNDDNQYRSKRQIFTFFSKKFTSQDVNSEEQHLVKFRDVIQYLNHYPSAWNKHLELKSGYPQMTDKLMRYIVEAEIYRSFPDQTDNHRFLLFAIREFFGQSCLDTWTGNTPINFSNQEQKGFSYEINTSAEIKDIETKLKALVLKGPLNFKEKKEQNRLEKDLRREKKEQPTNRVKEKLLTRIQHNMLYVSYGRNQDRFMDFAARFLAETDYFGKDAKFKMYQFYTSDEQRDHLKEQKKELPKKEFEKLKYHQSKLVDYFTYAEQQARYPDWDTPFVVENNAIQIKVTLFNGAKKIVSVQRNLMLYLLEDALYSEKRENAGKGLISGYFVHHQKELKDQLDILEKETEISREQKREFKKLLPKRLLHRYSPAQINDTTEWNPMEVILEEAKAQEQRYQLLLEKAILHQTEEDFLKRNKGKQFKLRFVRKAWHLMYLKELYMNKVAEHGHHKSFHITKEEFNDFCRWMFAFDEVPKYKEYLCDYFSQKGFFNNAEFKDLIESSTSLNDLYEKTKQRFEGWSKDLTKQSDENKYLLANYESMLKDDMLYVNISHFISYLESKGKINRNAHGHIAYKALNNVPHLIEEYYYKDRLAPEEYKSHGKLYNKLKTVKLEDALLYEMAMHYLSLEPALVPKVKTKVKDILSSNIAFDIKDAAGHHLYHLLIPFHKIDSFVALINHQSQQEKDPDKTSFLAKIQPYLEKVKNSKDLKAVYHYYKDTPHTLRYEDLNMIHSHIVSQSVQFTKVALKLEEYFIAKKSITLQIARQISYSEIADLSNYFTDEVRNTAFHFDVPETAYSMILQGIESEFLDREIKPQKPKSLSELSTQQVSVCTAFLETLHNNLFDRKDDKKERLSKARERYFEQIN

SEQ ID NO: 414 - RNA, 25 nt, Artificial sequence
  RNA aptamer
gggaacaaagcugaaguacuuaccc

SEQ ID NO: 415 - DNA, 18 bp, Artificial Sequence
  Synthetic G-quadraplex
gggtagggcgggttggga

SEQ ID NO: 416 - RNA, 12 nt, Artificial sequence
  synthetic linker
  misc_feature (1)..(1): 5Biosg
  misc_feature (12)..(12): 3IAbRQSp
ucucguacguuc

SEQ ID NO: 417 - RNA, 24 nt, Artificial Sequence
  Synthetic tag
  misc_feature (1)..(1): 5Biosg
  misc_feature (24)..(24): 3IAbRQSp
ucucguacguucucucguacguuc

SEQ ID NO: 418 - DNA, 10 bp, Artificial Sequence
  synthetic
tatatatata

SEQ ID NO: 419 - DNA, 15 bp, Artificial Sequence
  Synthetic
gtcgtcgtcgtcgtc

SEQ ID NO: 420 - DNA, 22 bp, Artificial Sequence
  Synthetic primer
gtggaattgtgagcggataaac

SEQ ID NO: 421 - DNA, 21 bp, Artificial Sequence
  Synthetic primer
aacagcaatctactcgacctg

SEQ ID NO: 422 - DNA, 28 bp, Artificial Sequence
  Synthetic primer
  misc_feature (1)..(1): 56-FAM fluorophore
  misc_feature (9)..(10): internal ZEN quencher
  misc_feature (28)..(28): 3IABkFQ quencher
aggaaacagctatgaccatgattacgcc

SEQ ID NO: 423 - skipped

SEQ ID NO: 424 - DNA, 25 bp, Artificial Sequence
  Synthetic
ggttggtagtctcgaattgctctct

SEQ ID NO: 425 - RNA, 44 nt, Artificial Sequence
  Synthetic
gcaaggggacuaaaacuagauugcuguucuaccaaguaauccau

SEQ ID NO: 426 - RNA, 23 nt, Artificial Sequence
  Synthetic
uagauugcuguucuaccaaguaa

SEQ ID NO: 427 - RNA, 20 nt, Artificial Sequence
  Synthetic
uagauugcuguucuaccaag

SEQ ID NO: 428 - RNA, 28 nt, Artificial Sequence
  Synthetic
auggauuacuugguagaacagcaaucua

SEQ ID NO: 429 - RNA, 28 nt, Artificial Sequence
  Sytthetic
auggauuacuugguagaacagcaaugua

SEQ ID NO: 430 - RNA, 17 nt, Artificial Sequence
  Synthetic
uagauugcuguucuacc

SEQ ID NO: 431 - RNA, 17 nt, Artificial Sequence
  Synthetic
aagauugcuguucuacc

SEQ ID NO: 432 - RNA, 17 nt, Artificial Sequence
  Synthetic
uugauugcuguucuacc

SEQ ID NO: 433 - RNA, 17 nt, Artificial Sequence
  Synthetic
uaguuugcuguucuacc

SEQ ID NO: 434 - RNA, 17 nt, Artificial Sequence
  Synthetic
uagaaugcuguucuacc

SEQ ID NO: 435 - RNA, 17 nt, Artificial Sequence
  Synthetic
uagauagcuguucuacc

SEQ ID NO: 436 - RNA, 17 nt, Artificial Sequence
  Synthetic
uagauuccuguucuacc

SEQ ID NO: 437 - RNA, 30 nt, Artificial Sequence
  Synthetic
auggauuacuugguagaacagaaucuacuc

SEQ ID NO: 438 - RNA, 30 nt, Artificial Sequence
  Synthetic
auggauuacuugguagaacagaauguacuc

SEQ ID NO: 439 - RNA, 28 nt, Artificial Sequence
  Synthetic
aagauugcuguucuaccaaguaauccau

SEQ ID NO: 440 - RNA, 28 nt, Artificial Sequence
  Synthetic
uugauugcuguucuaccaaguaauccau

SEQ ID NO: 441 - RNA, 28 nt, Artificial Sequence
  Synthetic
uaguuugcuguucuaccaaguaauccau

SEQ ID NO: 442 - RNA, 28 nt, Artificial Sequence
  Synthetic
uagaaugcuguucuaccaaguaauccau

SEQ ID NO: 443 - RNA, 28 nt, Artificial Sequence
  Synthetic
uagauagcuguucuaccaaguaauccau

SEQ ID NO: 444 - RNA, 28 nt, Artificial Sequence
  Synthetic
uagauuccuguucuaccaaguaauccau

SEQ ID NO: 445 - RNA, 28 nt, Artificial Sequence
  Synthetic
cuagauugcuguucuaccaaguaaucca

SEQ ID NO: 446 - RNA, 28 nt, Artificial Sequence
  Synthetic
gaagauugcuguucuaccaaguaaucca

SEQ ID NO: 447 - RNA, 28 nt, Artificial Sequence
  Synthetic
guugauugcuguucuaccaaguaaucca

SEQ ID NO: 448 - RNA, 28 nt, Artificial Sequence
  Synthetic
guaguuugcuguucuaccaaguaaucca

SEQ ID NO: 449 - RNA, 28 nt, Artificial Sequence
  Synthetic
guagaaugcuguucuaccaaguaaucca

SEQ ID NO: 450 - RNA, 28 nt, Artificial Sequence
  Synthetic
guagauagcuguucuaccaaguaaucca

SEQ ID NO: 451 - RNA, 28 nt, Artificial Sequence
  Synthetic
acuagauugcuguucuaccaaguaaucc

SEQ ID NO: 452 - RNA, 28 nt, Artificial Sequence
  Synthetic
agaagauugcuguucuaccaaguaaucc

SEQ ID NO: 453 - RNA, 28 nt, Artificial Sequence
  Synthetic
aguugauugcuguucuaccaaguaaucc

SEQ ID NO: 454 - RNA, 28 nt, Artificial Sequence
  Synthetic
aguaguuugcuguucuaccaaguaaucc

SEQ ID NO: 455 - RNA, 28 nt, Artificial Sequence
  Synthetic
aguagaaugcuguucuaccaaguaaucc

SEQ ID NO: 456 - RNA, 28 nt, Artificial Sequence
  Synthetic
aguagauagcuguucuaccaaguaaucc

SEQ ID NO: 457 - RNA, 28 nt, Artificial Sequence
  Synthetic
gacuagauugcuguucuaccaaguaauc

SEQ ID NO: 458 - RNA, 28 nt, Artificial Sequence
  Synthetic
gagaagauugcuguucuaccaaguaauc

SEQ ID NO: 459 - RNA, 28 nt, Artificial Sequence
  Synthetic
gaguugauugcuguucuaccaaguaauc

SEQ ID NO: 460 - RNA, 28 nt, Artificial Sequence
  Synthetic
gaguaguuugcuguucuaccaaguaauc

SEQ ID NO: 461 - RNA, 28 nt, Artificial Sequence
  Synthetic
gaguagaaugcuguucuaccaaguaauc

SEQ ID NO: 462 - RNA, 28 nt, Artificial Sequence
  Synthetic
gaguagauagcuguucuaccaaguaauc

SEQ ID NO: 463 - DNA, 57 bp, Artificial Sequence
  P. falciparum target
gaaattaatacgactcactatagggttattgcaattattaatcttgaacgaggaatg

SEQ ID NO: 464 - DNA, 57 bp, Artificial Sequence
  P. falciparum
gaaattaatacgactcactataggggattgacagattaatagctctttcttgatttc

SEQ ID NO: 465 - DNA, 32 bp, Artificial Sequence
  P. falciparum
atttttcttgtccaaacaattcatcatatctt

SEQ ID NO: 466 - DNA, 32 bp, Artificial Sequence
  P. falciparum
ttcaatttcaaataagaatatagtgtactcgc

SEQ ID NO: 467 - DNA, 57 bp, Artificial Sequence
  P. falciparum
gaaattaatacgactcactatagggttcttattagcagaacaaagaagtttaacaac

SEQ ID NO: 468 - DNA, 57 bp, Artificial Sequence
  P. falciparum
gaaattaatacgactcactatagggattttatgcaatgttaaaaactgttccaagta

SEQ ID NO: 469 - DNA, 32 bp, Artificial Sequence
  P. falciparum
taattgacatccaatccataataaagcataga

SEQ ID NO: 470 - DNA, 32 bp, Artificial Sequence
  P. falciparum
gaattatagttgttaaacttctttgttctgct

SEQ ID NO: 471 - DNA, 89 bp, Artificial Sequence
  P. falciparum
cctagtaagcatgattcatcagattgtggttttagtccccttcgtttttggggtagtctaaatcccctatagtgagtcgtattaatttc

SEQ ID NO: 472 - DNA, 89 bp, Artificial Sequence
  P. falciparum
ggatggtgatgcatggccgtttttagttgttttagtccccttcgtttttggggtagtctaaatcccctatagtgagtcgtattaatttc

SEQ ID NO: 473 - DNA, 89 bp, Artificial Sequence
  P falciparum
caatttaaaatgatttttggtgctagaggttttagtccccttcgtttttggggtagtctaaatcccctatagtgagtcgtattaatttc

SEQ ID NO: 474 - DNA, 89 bp, Artificial Sequence
  P. falciparum
gctggtttagtaattgtattattatcatgttttagtccccttcgtttttggggtagtctaaatcccctatagtgagtcgtattaatttc

SEQ ID NO: 475 - DNA, 124 bp, Artificial Sequence
  Synthetic
tacttggtagaacagcaatctactcgacctgcaggcatgcaagcttggcgtaatcatggtcatagctgtttcctgtgtttatccgctcacaattccacacaacatacgagccggaagcataaag

SEQ ID NO: 476 - DNA, 124 bp, Artificial Sequence
  Synthetic
atgaaccatcttgtcgttagatgagctggacgtccgtacgttcgaaccgcattagtaccagtatcgacaaaggacacaaataggcgagtgttaaggtgtgttgtatgctcggccttcgtattta

SEQ ID NO: 477 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 478 - protein, 1276 aa, Blautia sp.Marseille-P2398 (C2-29); identical to SEQ ID NO: 319

SEQ ID NO: 479 - protein, 948 aa, Artificial Sequence; identical to SEQ ID NO: 378
  Riemerella anatipestifer

SEQ ID NO: 480 - protein, 948 aa, Artificial Sequence; identical to SEQ ID NO: 403
  Riemerella anatipestifer

SEQ ID NO: 481 - protein, 950 aa, Artificial Sequence; identical to SEQ ID NO: 409
  Riemerella anatipestifer

SEQ ID NO: 482 - protein, 953 aa, Alistipes sp. ZOR0009; identical to SEQ ID NO: 331

SEQ ID NO: 483 - protein, 1036 aa, Artificial Sequence; identical to SEQ ID NO: 365
  Chryseobacterium ureilyticum

SEQ ID NO: 484 - protein, 1090 aa, Artificial Sequence; identical to SEQ ID NO: 341
  Prevotella sp.

SEQ ID NO: 485 - protein, 1090 aa, Artificial Sequence; identical to SEQ ID NO: 396
  Prevotella sp.

SEQ ID NO: 486 - protein, 1090 aa, Artificial Sequence; identical to SEQ ID NO: 397
  Prevotella sp.

SEQ ID NO: 487 - protein, 1090 aa, Artificial Sequence; identical to SEQ ID NO: 398
  Prevotella sp.

SEQ ID NO: 488 - protein, 1095 aa, Artificial Sequence; identical to SEQ ID NO: 334
  Riemerella anatispestifer

SEQ ID NO: 489 - protein, 1095 aa, Artificial Sequence; identical to SEQ ID NO: 411
  Riemerella anatispestifer

SEQ ID NO: 490 - protein, 1115 aa, Artificial Sequence; identical to SEQ ID NO: 330
  Synthetic

SEQ ID NO: 491 - protein, 1115 aa, Artificial Sequence; identical to SEQ ID NO: 357
  Bacteroides pyogenes

SEQ ID NO: 492 - protein, 1116 aa, Artificial Sequence; identical to SEQ ID NO: 386
  Prevotella pleuritidis

SEQ ID NO: 493 - protein, 1119 aa, Artificial Sequence; identical to SEQ ID NO: 345
  Porphyromonas gingivalis

SEQ ID NO: 494 - protein, 1119 aa, Artificial Sequence; identical to SEQ ID NO: 373
  Porphyromonas gingivalis

SEQ ID NO: 495 - protein, 1119 aa, Artificial Sequence; identical to SEQ ID NO: 375
  Porphyromonas gingivalis

SEQ ID NO: 496 - protein, 1119 aa, Artificial Sequence; identical to SEQ ID NO: 387
  Porphyromonas gingivalis

SEQ ID NO: 497 - protein, 1119 aa, Artificial Sequence; identical to SEQ ID NO: 389
  Porphyromonas gulae

SEQ ID NO: 498 - protein, 1119 aa, Artificial Sequence; identical to SEQ ID NO: 390
  Porphyromonas gulae

SEQ ID NO: 499 - protein, 1119 aa, Artificial Sequence; identical to SEQ ID NO: 392
  Porphyromonas gulae

SEQ ID NO: 500 - protein, 1119 aa, Artificial Sequence; identical to SEQ ID NO: 407
  Porphyromonas gingivalis

SEQ ID NO: 501 - protein, 1120 aa, Artificial Sequence; identical to SEQ ID NO: 338
  Prevotella intermedia

SEQ ID NO: 502 - protein, 1124 aa, Artificial Sequence; identical to SEQ ID NO: 335
  Prevotella aurantiaca

SEQ ID NO: 503 - protein, 1125 aa, Artificial Sequence; identical to SEQ ID NO: 351
  Prevotella pallens

SEQ ID NO: 504 - protein, 1125 aa, Artificial Sequence; identical to SEQ ID NO: 361
  Prevotella intermedia ZT

SEQ ID NO: 505 - protein, 1125 aa, Artificial Sequence; identical to SEQ ID NO: 351
  Prevotella pallens

SEQ ID NO: 506 - protein, 1126 aa, Artificial Sequence; identical to SEQ ID NO: 327
  Prevotella intermedia

SEQ ID NO: 507 - protein, 1127 aa, Artificial Sequence; identical to SEQ ID NO: 328
  Prevotella buccae

SEQ ID NO: 508 - protein, 1127 aa, Artificial Sequence; identical to SEQ ID NO: 328
  Prevotella buccae

SEQ ID NO: 509 - protein, 1127 aa, Artificial Sequence; identical to SEQ ID NO: 328
  Prevotella buccae

SEQ ID NO: 510 - protein, 1127 aa, Artificial Sequence; identical to SEQ ID NO: 372
  Prevotella sp. MSX73

SEQ ID NO: 511 - protein, 1131 aa, Artificial Sequence; identical to SEQ ID NO: 399
  Phaeodactylibacter xiamenensis

SEQ ID NO: 512 - protein, 1132 aa, Artificial Sequence; identical to SEQ ID NO: 347
  Prevotella intermedia

SEQ ID NO: 513 - protein, 1133 aa, Artificial Sequence; identical to SEQ ID NO: 349
  Prevotella intermedia

SEQ ID NO: 514 - protein, 1133 aa, Artificial Sequence; identical to SEQ ID NO: 385
  Prevotella falsenii

SEQ ID NO: 515 - protein, 1133 aa, Artificial Sequence; identical to SEQ ID NO: 413
  Reichenbachiella agariperforans

SEQ ID NO: 516 - protein, 1134 aa, Artificial Sequence; identical to SEQ ID NO: 348
  Prevotella intermedia 17

SEQ ID NO: 517 - protein, 1135 aa, Artificial Sequence; identical to SEQ ID NO: 329
  Synthetic

SEQ ID NO: 518 - protein, 1135 aa, Artificial Sequence; identical to SEQ ID NO: 358
  Porphyromonas gingivalis

SEQ ID NO: 519 - protein, 1135 aa, Artificial Sequence; identical to SEQ ID NO: 359
  Porphyromonas gingivalis

SEQ ID NO: 520 - protein, 1135 aa, Artificial Sequence; identical to SEQ ID NO: 360
  Porphyromonas gingivalis

SEQ ID NO: 521 - protein, 1135 aa, Artificial Sequence; identical to SEQ ID NO: 367
  Porphyromonas gingivalis

SEQ ID NO: 522 - protein, 1135 aa, Artificial Sequence; identical to SEQ ID NO: 358
  Porphyromonas gingivalis

SEQ ID NO: 523 - protein, 1135 aa, Artificial Sequence; identical to SEQ ID NO: 381
  Porphyromonas gingivalis

SEQ ID NO: 524 - protein, 1135 aa, Artificial Sequence; identical to SEQ ID NO: 359
  Porphyromonas gingivalis

SEQ ID NO: 525 - protein, 1135 aa, Artificial Sequence; identical to SEQ ID NO: 360
  Porphyromonas gingivalis

SEQ ID NO: 526 - protein, 1135 aa, Artificial Sequence; identical to SEQ ID NO: 384
  Porphyromonas gingivalis

SEQ ID NO: 527 - protein, 1135 aa, Artificial Sequence; identical to SEQ ID NO: 394
  Porphyromonas gulae

SEQ ID NO: 528 - protein, 1135 aa, Artificial Sequence; identical to SEQ ID NO: 408
  Porphyromonas gingivalis

SEQ ID NO: 529 - protein, 1139 aa, Artificial Sequence; identical to SEQ ID NO: 379
  Prevotella pleuritidis

SEQ ID NO: 530 - protein, 1145 aa, Artificial Sequence; identical to SEQ ID NO: 377
  Psychroflexus torquis

SEQ ID NO: 531 - protein, 1145 aa, Artificial Sequence; identical to SEQ ID NO: 402
  Chryseobacterium sp. YR477

SEQ ID NO: 532 - protein, 1149 aa, Artificial Sequence; identical to SEQ ID NO: 412
  Sinomicrobium oceani

SEQ ID NO: 533 - protein, 1150 aa, Artificial Sequence; identical to SEQ ID NO: 342
  Flavobacterium branchiophilum

SEQ ID NO: 534 - protein, 1150 aa, Artificial Sequence; identical to SEQ ID NO: 355
  Prevotella saccharolytica

SEQ ID NO: 535 - protein, 1151 aa, Artificial Sequence; identical to SEQ ID NO: 336
  Prevotella saccharolytica

SEQ ID NO: 536 - protein, 1154 aa, Artificial Sequence; identical to SEQ ID NO: 374
  Paludibacter propionicigenes

SEQ ID NO: 537 - protein, 1155 aa, Artificial Sequence; identical to SEQ ID NO: 400
  Flavobacterium sp. 316

SEQ ID NO: 538 - protein, 1156 aa, Artificial Sequence; identical to SEQ ID NO: 364
  Chryseobacterium carnipullorum

SEQ ID NO: 539 - protein, 1157 aa, Artificial Sequence; identical to SEQ ID NO: 352
  Myroides odoratimimus

SEQ ID NO: 540 - protein, 1157 aa, Artificial Sequence; identical to SEQ ID NO: 353
  Myroides odoratimimus

SEQ ID NO: 541 - protein, 1157 aa, Artificial Sequence; identical to SEQ ID NO: 352
  Myroides odoratimimus

SEQ ID NO: 542 - protein, 1157 aa, Artificial Sequence; identical to SEQ ID NO: 353
  Myroides odoratimimus

SEQ ID NO: 543 - protein, 1159 aa, Artificial Sequence; identical to SEQ ID NO: 337
  Synthetic

SEQ ID NO: 544 - protein, 1159 aa, Artificial Sequence; identical to SEQ ID NO: 343
  Unknown

SEQ ID NO: 545 - protein, 1161 aa, Artificial Sequence; identical to SEQ ID NO: 362
  Bacteroidetes bacterium GWA2_31_9

SEQ ID NO: 546 - protein, 1165 aa, Artificial Sequence; identical to SEQ ID NO: 363
  Chryseobacterium jejuense

SEQ ID NO: 547 - protein, 1174 aa, Artificial Sequence; identical to SEQ ID NO: 393
  Porphyromonas gulae

SEQ ID NO: 548 - protein, 1175 aa, Artificial Sequence; identical to SEQ ID NO: 340
  Porphyromonas gulae

SEQ ID NO: 549 - protein, 1175 aa, Artificial Sequence; identical to SEQ ID NO: 346
  Unknown

SEQ ID NO: 550 - protein, 1175 aa, Artificial Sequence; identical to SEQ ID NO: 356
  Porphyromonas gingivalis JCVISC001

SEQ ID NO: 551 - protein, 1175 aa, Artificial Sequence; identical to SEQ ID NO: 368
  Porphyromonas gingivalis

SEQ ID NO: 552 - protein, 1175 aa, Artificial Sequence; identical to SEQ ID NO: 388
  Porphyromonas gulae

SEQ ID NO: 553 - protein, 1175 aa, Artificial Sequence; identical to SEQ ID NO: 391
  Porphyromonas gulae

SEQ ID NO: 554 - protein, 1175 aa, Artificial Sequence; identical to SEQ ID NO: 401
  Porphyromonas gulae

SEQ ID NO: 555 - protein, 1175 aa, Artificial Sequence; identical to SEQ ID NO: 404
  Porphyromonas gulae

SEQ ID NO: 556 - protein, 1175 aa, Artificial Sequence; identical to SEQ ID NO: 405
  Porphyromonas gingivalis

SEQ ID NO: 557 - protein, 1179 aa, Artificial Sequence; identical to SEQ ID NO: 376
  Flavobacterium columnare

SEQ ID NO: 558 - protein, 1199 aa, Artificial Sequence; identical to SEQ ID NO: 339
  Capnocytophaga canimorsus

SEQ ID NO: 559 - protein, 1213 aa, Artificial Sequence; identical to SEQ ID NO: 406
  Flavobacterium columnare

SEQ ID NO: 560 - protein, 1213 aa, Artificial Sequence; identical to SEQ ID NO: 410
  Flavobacterium columnare

SEQ ID NO: 561 - protein, 1214 aa, Artificial Sequence; identical to SEQ ID NO: 344
  Unknown

SEQ ID NO: 562 - protein, 1218 aa, Artificial Sequence; identical to SEQ ID NO: 395
  Capnocytophaga cynodegmi

SEQ ID NO: 563 - protein, 1224 aa, Artificial Sequence; identical to SEQ ID NO: 326
  Bergeyella zoohelcum

SEQ ID NO: 564 - protein, 1224 aa, Artificial Sequence; identical to SEQ ID NO: 326
  Bergeyella zoohelcum

SEQ ID NO: 565 - protein, 1322 aa, Artificial Sequence; identical to SEQ ID NO: 332
  Prevotella sp. MA2016

SEQ ID NO: 566 - protein, 1322 aa, Artificial Sequence; identical to SEQ ID NO: 332
  Unknown

SEQ ID NO: 567 - protein, 668 aa, Artificial Sequence
  Fusobacterium necrophorum subsp. funduliforme
MTEKKSIIFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKFDSMKAHFHNINSEDTKEAYFWDIHSSSNYKTKYNERKNLVNEYTELLGSSKEKKLLREEITQINRKLLKLKQEMEEITKKNSLFRLEYKMKIAFGFLFCEFDGNISKFKDEFDASNQEKIIQYHKNGEKYLTYFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKIKKFL

SEQ ID NO: 568 - protein, 796 aa, Artificial Sequence
  Tissierella sp. P1
MEKDKKGEKIDISQEMIEEDLRKILILFSRLRHSMVHYDYEFYQALYSGKDFVISDKNNLENRMISQLLDLNIFKELSKVKLIKDKAISNYLDKNTTIHVLGQDIKAIRLLDIYRDICGSKNGFNKFINTMITISGEEDREYKEKVIEHFNKKMENLSTYLEKLEKQDNAKRNNKRVYNLLKQKLIEQQKLKEWFGGPYVYDIHSSKRYKELYIERKKLVDRHSKLFEEGLDEKNKKELTKINDELSKLNSEMKEMTKLNSKYRLQYKLQLAFGFILEEFDLNIDTFINNFDKDKDLIISNFMKKRDIYLNRVLDRGDNRLKNIIKEYKFRDTEDIFCNDRDNNLVKLYILMYILLPVEIRGDFLGFVKKNYYDMKHVDFIDKKDKEDKDTFFHDLRLFEKNIRKLEITDYSLSSGFLSKEHKVDIEKKINDFINRNGAMKLPEDITIEEFNKSLILPIMKNYQINFKLLNDIEISALFKIAKDRSITFKQAIDEIKNEDIKKNSKKNDKNNHKDKNINFTQLMKRALHEKIPYKAGMYQIRNNISHIDMEQLYIDPLNSYMNSNKNNITISEQIEKIIDVCVTGGVTGKELNNNIINDYYMKKEKLVFNLKLRKQNDIVSIESQEKNKREEFVFKKYGLDYKDGEINIIEVIQKVNSLQEELRNIKETSKEKLKNKETLFRDISLINGTIRKNINFKIKEMVLDIVRMDEIRHINIHIYYKGENYTRSNIIKFKYAIDGENKKYYLKQHEINDINLELKDKFVTLICNMDKHPNKNKQTINLESNYIQNVKFIIP

SEQ ID NO: 569 - protein, 897 aa, Artificial Sequence
  Fusobacterium ulcerans
MENKGNNKKIDFDENYNILVAQIKEYFTKEIENYNNRIDNIIDKKELLKYSEKKEESEKNKKLEELNKLKSQKLKILTDEEIKADVIKIIKIFSDLRHSLMHYEYKYFENLFENKKNEELAELLNLNLFKNLTLLRQMKIENKTNYLEGREEFNIIGKNIKAKEVLGHYNLLAEQKNGFNNFINSFFVQDGTENLEFKKLIDEHFVNAKKRLERNIKKSKKLEKELEKMEQHYQRLNCAYVWDIHTSTTYKKLYNKRKSLIEEYNKQINEIKDKEVITAINVELLRIKKEMEEITKSNSLFRLKYKMQIAYAFLEIEFGGNIAKFKDEFDCSKMEEVQKYLKKGVKYLKYYKDKEAQKNYEFPFEEIFENKDTHNEEWLENTSENNLFKFYILTYLLLPMEFKGDFLGVVKKHYYDIKNVDFTDESEKELSQVQLDKMIGDSFFHKIRLFEKNTKRYEIIKYSILTSDEIKRYFRLLELDVPYFEYEKGTDEIGIFNKNIILTIFKYYQIIFRLYNDLEIHGLFNISSDLDKILRDLKSYGNKNINFREFLYVIKQNNNSSTEEEYRKIWENLEAKYLRLHLLTPEKEEIKTKTKEELEKLNEISNLRNGICHLNYKEIIEEILKTEISEKNKEATLNEKIRKVINFIKENELDKVELGFNFINDFFMKKEQFMFGQIKQVKEGNSDSITTERERKEKNNKKLKETYELNCDNLSEFYETSNNLRERANSSSLLEDSAFLKKIGLYKVKNNKVNSKVKDEEKRIENIKRKLLKDSSDIMGMYKAEVVKKLKEKLILIFKHDEEKRIYVTVYDTSKAVPENISKEILVKRNNSKEEYFFEDNNKKYVTEYYTLEITETNELKVIPAKKLEGKEFKTEKNKENKLMLNNHYCFNVKIIY

SEQ ID NO: 570 - protein, 919 aa, Artificial Sequence
  Cetobacterium sp, ZOR0034
MEEIKHKKNKSSIIRVIVSNYDMTGIKEIKVLYQKQGGVDTFNLKTIINLESGNLEIISCKPKEREKYRYEFNCKTEINTISITKKDKVLKKEIRKYSLELYFKNEKKDTVVAKVTDLLKAPDKIEGERNHLRKLSSSTERKLLSKTLCKNYSEISKTPIEEIDSIKIYKIKRFLNYRSNFLIYFALINDFLCAGVKEDDINEVWLIQDKEHTAFLENRIEKITDYIFDKLSKDIENKKNQFEKRIKKYKTSLEELKTETLEKNKTFYIDSIKTKITNLENKITELSLYNSKESLKEDLIKIISIFTNLRHSLMHYDYKSFENLFENIENEELKNLLDLNLFKSIRMSDEFKTKNRTNYLDGTESFTIVKKHQNLKKLYTYYNNLCDKKNGFNTFINSFFVTDGIENTDFKNLIILHFEKEMEEYKKSIEYYKIKISNEKNKSKKEKLKEKIDLLQSELINMREHKNLLKQIYFFDIHNSIKYKELYSERKNLIEQYNLQINGVKDVTAINHINTKLLSLKNKMDKITKQNSLYRLKYKLKIAYSFLMIEFDGDVSKFKNNFDPTNLEKRVEYLDKKEEYLNYTAPKNKFNFAKLEEELQKIQSTSEMGADYLNVSPENNLFKFYILTYIMLPVEFKGDFLGFVKNHYYNIKNVDFMDESLLDENEVDSNKLNEKIENLKDSSFFNKIRLFEKNIKKYEIVKYSVSTQENMKEYFKQLNLDIPYLDYKSTDEIGIFNKNMILPIFKYYQNVFKLCNDIEIHALLALANKKQQNLEYAIYCCSKKNSLNYNELLKTFNRKTYQNLSFIRNKIAHLNYKELFSDLFNNELDLNTKVRCLIEFSQNNKFDQIDLGMNFINDYYMKKTRFIFNQRRLRDLNVPSKEKIIDGKRKQQNDSNNELLKKYGLSRTNIKDIFNKAWY

SEQ ID NO: 571 - protein, 1110 aa, Artificial Sequence
  Fusobacterium necrophorum
MKVRYRKQAQLDTFIIKTEIVNNDIFIKSIIEKAREKYRYSFLFDGEEKYHFKNKSSVEIVKNDIFSQTPDNMIRNYKITLKISEKNPRVVEAEIEDLMNSTILKDGRRSARREKSMTERKLIEEKVAENYSLLANCPIEEVDSIKIYKIKRFLTYRSNMLLYFASINSFLCEGIKGKDNETEEIWHLKDNDVRKEKVKENFKNKLIQSTENYNSSLKNQIEEKEKLSSKEFKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTKLLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKNKKVSLKNNGMFNKTILLFVFKYYQIAFKLFNDIELYSLFFLREKSEKPFEVFLEELKDKMIGKQLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKKSEKEEILRKRYHLINKKNEQIKDEHEAQSQLYEKILSLQKIFSCDKNNFYRRLKEEKLLFLEKQGKKKISMKEIKDKIASDISDLLGILKKEITRDIKDKLTEKFRYCEEKLLNISFYNHQDKKKEEGIRVFLIRDKNSDNFKFESILDDGSNKIFISKNGKEITIQCCDKVLETLMIEKNTLKISSNGKIISLIPHYSYSIDVKY

SEQ ID NO: 572 - protein, 1110 aa, Artificial Sequence
  Fusobacterium necrophorum
MEKFRRQNRSSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEIEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKMAFGFLFCEFDGNISRFKDEFDASNQEKIIQYHKNGEKYLTYFLKEEEKEKFNLKKLQETIQKTGEENWLLPQNKNNLFKFYLLTYLLLPYELKGDFLGFVKKHYYDIKNVDFMDENQSSKIIESKEDDFYHKIRLFEKNTKKYEIVKYSIVPDKKLKQYFKDLGIDTKYLILDQKSEVSGEKNKKVSLKNNGMFNKTILLFVFKYYQIAFKLFNDIELYSLFFLREKSGKPFEVFLKELKDKMIGKQLNFGQLLYVVYEVLVKNKDLSEILSERIDYRKDMCFSAEIADLRNFLSHNYSKFLDNFMKINTNKSDENKEVLIPSIKIQKMIKFIEECNLQSQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQEKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 573 - protein, 1111 aa, Artificial Sequence
  Anaerosalibacer massiliensis
MKSGRREKAKSNKSSIVRVIISNFDDKQVKEIKVLYTKQGGIDVIKFKSTEKDEKGRMKFNFDCAYNRLEEEEFNSFGGKGKQSFFVTTNEDLTELHVTKRHKTTGEIIKDYTIQGKYTPIKQDRTKVTVSITDNKDHFDSNDLGDKIRLSRSLTQYTNRILLDADVMKNYREIVCSDSEKVDETINIDSQEIYKINRFLSYRSNMIIYYQMINNFLLHYDGEEDKGGNDSINLINEIWKYENKKNDEKEKIIERSYKSIEKSINQYILNHNTEVESGDKEKKIDISEERIKEDLKKTFILFSRLRHYMVHYNYKFYENLYSGKNFIIYNKDKSKSRRFSELLDLNIFKELSKIKLVKNRAVSNYLDKKTTIHVLNKNINAIKLLDIYRDICETKNGFNNFINNMMTISGEEDKEYKEMVTKHFNENMNKLSIYLENFKKHSDFKTNNKKKETYNLLKQELDEQKKLRLWFNAPYVYDIHSSKKYKELYVERKKYVDIHSKLIEAGINNDNKKKLNEINVKLCELNTEMKEMTKLNSKYRLQYKLQLAFGFILEEFNLDIDKFVSAFDKDNNLTISKFMEKRETYLSKSLDRRDNRFKKLIKDYKFRDTEDIFCSDRENNLVKLYILMYILLPVEIRGDFLGFVKKNYYDLKHVDFIDKRNNDNKDTFFHDLRLFEKNVKRLEVTSYSLSDGFLGKKSREKFGKELEKFIYKNVSIALPTNIDIKEFNKSLVLPMMKNYQIIFKLLNDIEISALFLIAKKEGNEGSITFKKVIDKVRKEDMNGNINFSQVMKMALNEKVNCQIRNSIAHINMKQLYIEPLNIYINNNQNKKTISEQMEEIIDICITKGLTGKELNKNIINDYYMKKEKLVFNLKLRKRNNLVSIDAQQKNMKEKSILNKYDLNYKDENLNIKEIILKVNDLNNKQKLLKETTEGESNYKNALSKDILLLNGIIRKNINFKIKEMILGIIQQNEYRYVNINIYDKIRKEDHNIDLKINNKYIEISCYENKSNESTDERINFKIKYMDLKVKNELLVPSCYEDIYIKKKIDLEIRYIENCKVVYIDIYYKKYNINLEFDGKTLFVKFNKDVKKNNQKVNLESNYIQNIKFIVS

SEQ ID NO: 574 - protein, 1111 aa, Artificial Sequence
  Fusobacterium necrophorum
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSVTERKLIEEKVAENYSLLANCPMEEVDSIKIYKIKRFLTYRSNMLLYFASINSFLCEGIKGKENETEEIWHLKDNDVRKEKVKENFKNKLIQSTENYNSSLKNQIEEKEKLLRKESKKGAFYRTIIKKLQQERIKELSEKSLTEDCEKIIKLYSKLRHSLMHYDYQYFENLFENKETPELKDKLDLHLFKSLPLIRKMKLNNKVNYLEDGDTLFVLQKTKKAKTLYQIYDALCEQKNGFNKFINDFFVSDGEENTVFKQIINEKFQSEMEFLGKRISESEEKNPKLKKKFDSMKAHFHNINSEDTKEAYFWDIHSSSNYKTKYNERKNLVNEYTELLGSSKEKKLLREEITQINRKLLKLKQEMEEITKKNSLFRLEYKMKMAFGFLFCEFDGNISRFKDEFDASNQEKIIQYHKNGEKYLTYFLKEEEKEKFNLKKLQETIQKTGKENWLLPQNKNNLFKFYLLTYLLLPYELKGDFLGFVKKHYYDIKNVDFMDENQSSKIIESKEDDFYHKIRLFEKNTKKYEIVKYSIVPDEKLKQYFKDLGIDTKYLILEQKSEVSGEKNKKVSLKNNGMFNKTILLFVFKYYQIAFKLFNDIELYSLFFLREKSGKPFEVFLKELKDKMIGKQLNFGQLLYVIYEVLVKNKDLSEILSERIDYRKDMCFSAEIADLRNFLSHLNYSKFLDNFMKINTNKSDENKEVLIPSIKIQKMIKFIEECNLQSQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLGKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLMIEKNTLKISSNGKIISLVPHYSYSIDVKY

SEQ ID NO: 575 - protein, 1115 aa, Artificial Sequence
  Fusobacterium necrophorum
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAKNYSLLANCPMEEVDSIKIYKIKRFLTYRSNMLLYFASINSFLCEGIKGKDNETEEIWHLKDNDVRKEKVRENFKNKLIQSTENYNSSLKNQIEEKEKLLRKEFKKGAFYRTIIKKLQQERIKELSEKSLTEDCEKIIKLYSKLRHSLMHYDYQYFENLFENKKNDDLMKDLNLDLFKSLPLIRKMKLNNKVNYLEDGDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFIDENQNNIQVSQTVEKQEDYFYHKIRLFEKNTKKYEIVKYSIVPNEKLKQYFEDLGIDIKYLTVEQKSEVSEEKNKKVSLKNNGMFNKTILLFVFKYYQIAFKLFNDIELYSLFFLREKSGKPLEIFRKELESKMKDGYLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 576 - protein, 1121 aa, Artificial Sequence
  Fusobacterium perfoetens
MGKPNRSSIIKIIISNYDNKGIKEVKVRYNKQAQLDTFLIKSELKDGKFILYSIVDKAREKYRYSFEIDKTNINKNEILIIKKDIYSNKEDKVIRKYILSFEVSEKNDRTIVTKIKDCLETQKKEKFERENTRRLISETERKLLSEETQKTYSKIACCSPEDIDSVKIYKIKRYLAYRSNMLLFFSLINDIFVKGVVKDNGEEVGEIWRIIDSKEIDEKKTYDLLVENFKKRMSQEFINYKQSIENKIEKNTNKIKEIEQKLKKEKYKKEINRLKKQLIELNRENDLLEKDKIELSDEEIREDIEKILKIYSDLRHKLMHYNYQYFENLFENKKISKEKNEDVNLTELLDLNLFRYLPLVRQLKLENKTNYLEKEDKITVLGVSDSAIKYYSYYNFLCEQKNGFNNFINSFFSNDGEENKSFKEKINLSLEKEIEIMEKETNEKIKEINKNELQLMKEQKELGTAYVLDIHSLNDYKISHNERNKNVKLQNDIMNGNRDKNALDKINKKLVELKIKMDKITKRNSILRLKYKLQVAYGFLMEEYKGNIKKFKDEFDISKEKIKSYKSKGEKYLEVKSEKKYITKILNSIEDIHNITWLKNQEENNLFKFYVLTYILLPFEFRGDFLGFVKKHYYDIKNVEFLDENNDRLTPEQLEKMKNDSFFNKIRLFEKNSKKYDILKESILTSERIGKYFSLLNTGAKYFEYGGEENRGIFNKNIIIPIFKYYQIVLKLYNDVELAMLLTLSESDEKDINKIKELVTLKEKVSPKKIDYEKKYKFSVLLDCFNRIINLGKKDFLASEEVKEVAKTFTNLAYLRNKICHLNYSKFIDDLLTIDTNKSTTDSEGKLLINDRIRKLIKFIRENNQKMNISIDYNYINDYYMKKEKFIFGQRKQAKTIIDSGKKANKRNKAEELLKMYRVKKENINLIYELSKKLNELTKSELFLLDKKLLKDIDFTDVKIKNKSFFELKNDVKEVANIKQALQKHSSELIGIYKKEVIMAIKRSIVSKLIYDEEKVLSIIIYDKTNKKYEDFLLEIRRERDINKFQFLIDEKKEKLGYEKIIETKEKKKVVVKIQNNSELVSEPRIIKNKDKKKAKTPEEISKLGILDLTNHYCFNLKITL

SEQ ID NO: 577 - protein, 1137 aa, Artificial Sequence
  Fusobacterium necrophorum
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAKNYSLLANCPMEEVDSIKIYKIKRFLTYRSNMLLYFASINSFLCEGIKGKDNETEEIWHLKDNDVRKEKVRENFKNKLIQSTENYNSSLKNQIEEKEKLLRKEFKKGAFYRTIIKKLQQERIKELSEKSLTEDCEKIIKLYSKLRHSLMHYDYQYFENLFENKKNDDLMKDLNLDLFKSLPLIRKMKLNNKVNYLEDGDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFIDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKNKKVSLKNNGMFNKTILLFVFKYYQIAFKLFNDIELYSLFFLREKSGKPLEIFRKELESKMKDGYLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 578 - protein, 1158 aa, Artificial Sequence
  Fusobacterium varium
MENKNKPNRGSIVRIIISNYDMKGIKELKVRYRKQAQLDTFILQTTLDKSNNSILINDFRVKAREKYRYSFTYDGKEKFSVPSNSIIVTKIDNAAPEKSKEIRKYKITLGIDEKCKTGSMITAAIEDLLEDDRVREGIRNPRRKASKTERKLITESICHNYAQITQCPVEEIDAVKIYKVKRFLSYRSNMLLFFALINDFLCKNLKNEKGEKINEIWEMENKGNNKKIDFDENYNILVAQIKEYFTKEIENYNNRIDNIIDKKELLKYSEEKEESEKNKKLEELNKLESQKLKILTDEEIKADVIKIIKIFSDLRHSLMHYEYKYFENLFENKKNEELAELLNLNLFKNLTLLRQMKIENKTNYLEGDEKFNILGKDVRAKNALGHYDLLVEQKNGFNNFINSFFVQDGTENLEFKKFIDENFIKAQKELEEDIKNCKESVKKLEKKLKENPKKSEDLEKKLEKKQKKLKELKKELEKMKQHYKRLNCAYVWDIHSSTVYKKLYNERKNLIEKYNKQLNGLQDKNAITGINAQLLRIKKEMEEITKSNSLFRLKYKMQIAYAFLEMEYEGNIAKFKNEFDCSKTEKIQEWLEKSEEYLNYCMEKEEDGKNYKFHFKEISEIKDTHNEEWLENTSENNLFKFYILTYLLLPMEFKGDFLGVVKKHYYDIKNVDFTDESEKELSQEQIDKMIGDSFFHKIRLFEKNTKRYEIIKYSILTSDEIKKYFELLELKVPYLEYKGIDEIGIFNKNIILPIFKYYQIIFRLYNDLEIHGLFNVSFDINKILSDLKSYGNENINFREFLYVIKQNNNSSTEEEYQKIWEKLESKYLKEPLLTPEKKEINKKTEKELKKLDGISFLRNKISHLEYEKIIEGVLKTAVNGENKKTSETNADKVFLNEKIKKIINFIKENELDKIELGFNFINDFFMKKEQFMFGQIKQVKEGNSDSITTERKRKEENNKRLKITYGLNYNNLSKIYEFSNTLREIVNSPLFLKDSTLLKKVDLSKVMLKEKPICSLQYENNTKLEDDIKRILLKDSSDIMGIYKAEVVKKLKEKLVLIFKYDEEKKIYVTVYDTSKAVPENISKEILVKRNNSKEEYFFEDNKKKYTTQYYTLEITKENELKVIPAKKLEGKEFKTEKKEENKLMLNNHYCFNVKIIY

SEQ ID NO: 579 - protein, 1385 aa, Leptotrichia sp oral taxon
MGNLFGHKRWYEVRDKKDFKIKRKVKVKRNYDGNKYILNINENNNKEKIDNNKFIGEFVNYKKNNNVLKEFKRKFHAGNILFKLKGKEEIIRIENNDDFLETEEVVLYIEVYGKSEKLKALEITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDNKIDVILTNFMEIREKIKSNLEIMGFVKFYLNVSGDKKKSENKKMFVEKILNTNVDLTVEDIVDFIVKELKFWNITKRIEKVKKFNNEFLENRRNRTYIKSYVLLDKHEKFKIERENKKDKIVKFFVENIKNNSIKEKIEKILAEFKINELIKKLEKELKKGNCDTEIFGIFKKHYKVNFDSKKFSNKSDEEKELYKIIYRYLKGRIEKILVNEQKVRLKKMEKIEIEKILNESILSEKILKRVKQYTLEHIMYLGKLRHNDIVKMTVNTDDFSRLHAKEELDLELITFFASTNMELNKIFNGKEKVTDFFGFNLNGQKITLKEKVPSFKLNILKKLNFINNENNIDEKLSHFYSFQKEGYLLRNKILHNSYGNIQETKNLKGEYENVEKLIKELKVSDEEISKSLSLDVIFEGKVDIINKINSLKIGEYKDKKYLPSFSKIVLEITRKFREINKDKLFDIESEKIILNAVKYVNKILYEKITSNEENEFLKTLPDKLVKKSNNKKENKNLLSIEEYYKNAQVSSSKGDKKAIKKYQNKVTNAYLEYLENTFTEIIDFSKFNLNYDEIKTKIEERKDNKSKIIIDSISTNINITNDIEYIISIFALLNSNTYINKIRNRFFATSVWLEKQNGTKEYDYENIISILDEVLLINLLRENNITDILDLKNAIIDAKIVENDETYIKNYIFESNEEKLKKRLFCEELVDKEDIRKIFEDENFKFKSFIKKNEIGNFKINFGILSNLECNSEVEAKKIIGKNSKKLESFIQNIIDEYKSNIRTLFSSEFLEKYKEEIDNLVEDTESENKNKFEKIYYPKEHKNELYIYKKNLFLNIGNPNFDKIYGLISKDIKNVDTKILFDDDIKKNKISEIDAILKNLNDKLNGYSNDYKAKYVNKLKENDDFFAKNIQNENYSSFGEFEKDYNKVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFRLIGNNDILERLMKPKKVSVLELESYNSDYIKNLIIELLTKIENTNDTL

SEQ ID NO: 580 - protein, 1389 aa, Leptotrichia shahii; identical to SEQ ID NO: 477

SEQ ID NO: 581 - protein, 1197 aa, Leptotrichia wadei; identical to SEQ ID NO: 2

SEQ ID NO: 582 - protein, 1120 aa, Listeria seeligeri; identical to SEQ ID NO: 3

SEQ ID NO: 583 - protein, 1340 aa, Lachnospiraceae bacterium; identical to SEQ ID NO: 4

SEQ ID NO: 584 - protein, 1437 aa, Lachnospiraceae bacterium; identical to SEQ ID NO: 5

SEQ ID NO: 585 - protein, 1385 aa, Clostridium aminophilum; identical to SEQ ID NO: 6

SEQ ID NO: 586 - protein, 1175 aa, Carnobacterium gallinarum; identical to SEQ ID NO: 7

SEQ ID NO: 587 - protein, 1164 aa, Carnobacterium gallinarum; identical to SEQ ID NO: 8

SEQ ID NO: 588 - protein, 1154 aa, Paludibacter propionicigenes; identical to SEQ ID NO: 9

SEQ ID NO: 589 - protein, 970 aa, Listeria weihenstephanensis; identical to SEQ ID NO: 10

SEQ ID NO: 590 - protein, 1051 aa, Listeriaceae bacterium; identical to SEQ ID NO: 11

SEQ ID NO: 591 - protein, 1152 aa, Leptotrichia wadei; identical to SEQ ID NO: 12

SEQ ID NO: 592 - protein, 1285 aa, Rhodobacter capsulatus; identical to SEQ ID NO: 13

SEQ ID NO: 593 - protein, 1285 aa, Rhodobacter capsulatus; identical to SEQ ID NO: 14

SEQ ID NO: 594 - protein, 1285 aa, Rhodobacter capsulatus; identical to SEQ ID NO: 14

SEQ ID NO: 595 - protein, 1159 aa, Leptotrichia buccalis; identical to SEQ ID NO: 309

SEQ ID NO: 596 - protein, 1285 aa, Herbinix hemicellulosilytica; identical to SEQ ID NO: 310

SEQ ID NO: 597 - protein, 1344 aa, Eubacterium rectale; identical to SEQ ID NO: 311

SEQ ID NO: 598 - protein, 1373 aa, Eubacteriaceae bacterium; identical to SEQ ID NO: 312

SEQ ID NO: 599 - protein, 1276 aa, Blautia sp.; identical to SEQ ID NO: 319

SEQ ID NO: 600 - protein, 1385 aa, Leptotrichia sp.; identical to SEQ ID NO: 579

SEQ ID NO: 601 - protein, 1224 aa, Bergeyella zoohelcum; identical to SEQ ID NO: 326

SEQ ID NO: 602 - protein, 1126 aa, Prevotella intermedia; identical to SEQ ID NO: 327

SEQ ID NO: 603 - protein, 1127 aa, Prevotella buccae; identical to SEQ ID NO: 328

SEQ ID NO: 604 - protein, 953 aa, Alistipes sp.; identical to SEQ ID NO: 331

SEQ ID NO: 605 - protein, 1322 aa, Prevotella sp.; identical to SEQ ID NO: 332

SEQ ID NO: 606 - protein, 1095 aa, Riemerella anatipestifer; identical to SEQ ID NO: 334

SEQ ID NO: 607 - protein, 1124 aa, Prevotella aurantiaca; identical to SEQ ID NO: 335

SEQ ID NO: 608 - protein, 1151 aa, Prevotella saccharolytica; identical to SEQ ID NO: 336

SEQ ID NO: 609 - protein, 1120 aa, Prevotella intermedia; identical to SEQ ID NO: 338

SEQ ID NO: 610 - protein, 1199 aa, Capnocytophaga canimorsus; identical to SEQ ID NO: 339

SEQ ID NO: 611 - protein, 1175 aa, Porphyromonas gulae; identical to SEQ ID NO: 340

SEQ ID NO: 612 - protein, 1090 aa, Prevotella sp.; identical to SEQ ID NO: 341

SEQ ID NO: 613 - protein, 1150 aa, Flavobacterium branchiophilum; identical to SEQ ID NO: 342

SEQ ID NO: 614 - protein, 1119 aa, Porphyromonas gingivalis; identical to SEQ ID NO: 345

SEQ ID NO: 615 - protein, 1132 aa, Prevotella intermedia; identical to SEQ ID NO: 347

SEQ ID NO: 616 - protein, 1115 aa, Fusobacterium necrophorum; identical to SEQ ID NO: 575

SEQ ID NO: 617 - protein, 1111 aa, Fusobacterium necrophorum
MEKFRRQNRSSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEIEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKMAFGFLFCEFDGNISRFKDEFDASNQEKIIQYHKNGEKYLTYFLKEEEKEKFNLKKLQETIQKTGEENWLLPQNKNNLFKFYLLTYLLLPYELKGDFLGFVKKHYYDIKNVDFMDENQSSKIIESKEDDFYHKIRLFEKNTKKYEIVKYSIVPDKKLKQYFKDLGIDTKYLILDQKSEVSGEKNKKVSLKNNGMFNKTILLFVFKYYQIAFKLFNDIELYSLFFLREKSGKPFEVFLKELKDKMIGKQLNFGQLLYVVYEVLVKNKDLSEILSERIDYRKDMCFSAEIADLRNFLSHLNYSKFLDNFMKINTNKSDENKEVLIPSIKIQKMIKFIEECNLQSQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQEKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 618 - protein, 1110 aa, Fusobacterium necrophorum; identical to SEQ ID NO: 571

SEQ ID NO: 619 - protein, 668 aa, Fusobacterium necrophorum; identical to SEQ ID NO: 567

SEQ ID NO: 620 - protein, 1121 aa, Fusobacterium perfoetens; identical to SEQ ID NO: 576

SEQ ID NO: 621 - protein, 897 aa, Fusobacterium ulcerans; identical to SEQ ID NO: 569

SEQ ID NO: 622 - protein, 1111 aa, Anaerosalibacter sp.; identical to SEQ ID NO: 573

What is claimed is:

1. A diagnostic device comprising one or more individual discrete volumes, each individual discrete volume comprising nucleic acid amplification reagents for amplifying a target sequence, a Cas13 protein exhibiting collateral activity and one or more guide polynucleotides comprising a guide sequence capable of binding the target sequence and designed to form a complex with the Cas protein; and a masking construct.

2. The diagnostic device of claim 1, wherein each individual discrete volume further comprises one or more detection aptamers comprising a masked RNA polymerase promoter binding site or a masked primer binding site.

3. The diagnostic device of claim 1, wherein the amplification reagents comprise a primer comprising an RNA polymerase promoter.

4. The diagnostic device of claim 1, wherein the target molecule is a target DNA and each individual discrete volume further comprises a primer that binds the target DNA and comprises a RNA polymerase promoter.

5. The diagnostic device of claim 1, wherein the one or more individual discrete volumes are droplets.

6. The diagnostic device of claim 1, wherein the one or more individual discrete volumes are defined on a solid substrate, are spots defined on a substrate, are placed within microwells, or are microfluidic channels in a lab-on-chip (LOC) device.

7. The diagnostic device of claim 6, wherein the substrate is a flexible materials substrate, a paper substrate, a flexible polymer based substrate, or a lateral flow strip.

8. The diagnostic device of claim 6, wherein the LOC is a radio frequency identification (RFID) tag system.

9. The diagnostic device of claim 8, further comprising a wireless device configured to communicate with the RFID system.

10. The diagnostic device of claim 1, wherein the Cas13 protein is bound to each individual discrete volume.

11. The diagnostic device of claim 10, wherein the Cas13 protein is a fusion protein comprising an affinity tag, or is linked to a biotin molecule, and wherein each individual discrete volume comprises streptavidin.

12. The diagnostic device of claim 1, wherein the Cas13 protein comprises one or more higher eukaryotes and prokaryotes nucleotide-binding (HEPN) domains, and wherein the one or more HEPN domains comprise a RxxxxH motif sequence.

13. The diagnostic device of claim 12, wherein the RxxxxH motif comprises a R[N/H/K]$X_1X_2X_3$H sequence.

14. The diagnostic device of claim 13, wherein $X_1$ is R, S, D, E, Q, N, G, or Y, and $X_2$ is independently I, S, T, V, or L, and $X_3$ is independently L, F, N, Y, V, I, S, D, E, or A.

15. The diagnostic device of claim 1, wherein the Cas13 protein is C2c2.

16. The diagnostic device of claim 15, wherein the nucleic acid sequence encoding the C2c2 protein is naturally present in a prokaryotic genome within 20 kb of a Cas 1 gene.

17. The diagnostic device of claim 15, wherein the C2c2 effector protein k from an organism of a genus selected from the group consisting of: *Leptotrichia shahii*; *Leptotrichia wadei* (Lw2); *Listeria seeligeri*; Lachnospiraceae bacterium MA2020; Lachnospiraceae bacterium NK4A179; *Clostridium aminophilum* DSM 10710; *Carnobacterium gallinarum* DSM 4847; *Paludibacter propionicigenes* WB4; *Listeria weihenstephanensis* FSL R9-0317; Listeriaceae bacterium FSL M6-0635; *Leptotrichia wadei* F0279; *Rhodobacter capsulatus* SB 1003; *Rhodobacter capsulatus* R121; *Rhodobacter capsulatus* DE442; *Leptotrichia buccalis* C-1013-b; *Herbinix hemicellulosilytica*; *Eubacterium rectale*; Eubacteriaceae bacterium CHKCIO04; *Blautia* sp. Marseille-P2398; *Leptotrichia* sp. oral taxon 879 str.F0557; Lachnospiraceae bacterium NK4A144; *Chloroflexus aggregans*; *Demequina aurantiaca*; *Thalassospira* sp. TSL5-1; *Pseudobutyrivibrio* sp. OR37; *Butyrivibrio* sp. YAB3001; *Blautia* sp. Marseille-P2398; *Leptotrichia* sp. Marseille-P3007; *Bacteroides ihuae*; Porphyromonadaceae bacterium KH3CP3RA; *Listeria riparia*; and *Insolitispirillum peregrinum*.

18. The diagnostic device of claim 17, wherein the C2c2 effector protein is a *L. wadei* F0279 or *L. wadei* F0279 (Lw2) C2c2 effector protein.

19. The diagnostic device of claim 1, wherein the one or more guide RNAs are designed to detect a single nucleotide polymorphism in a target RNA or DNA, a splice variant of a RNA transcript, or a frameshift mutation in a target DNA or RNA.

20. The diagnostic device of claim 1, wherein the one or more guide RNAs are designed to bind to one or more target RNA sequences that are diagnostic for a disease state.

21. The diagnostic device of claim 1, wherein the masking construct is a RNA-based masking construct, wherein
the RNA-based masking construct is capable of suppressing generation of a detectable positive signal; or
the RNA-based masking construct is capable of masking a detectable positive signal; or
the RNA-based masking construct is capable of generating a detectable negative signal; or
the RNA-based masking construct is a conductive RNA molecule located across conductive leads; or
the RNA-based masking construct comprises a silencing RNA that is capable of suppressing generation of a gene product encoded by a reporting construct, wherein the gene product is capable of generating the detectable positive signal when expressed; or
the RNA-based masking construct is a ribozyme that is capable of generating a negative detectable signal, and wherein a positive detectable signal is generated when the ribozyme is deactivated; or the RNA-based masking construct is a RNA aptamer and/or comprises an RNA-tethered inhibitor;
wherein the aptamer or RNA-tethered inhibitor is capable of sequestering an enzyme, wherein the enzyme is capable of generating a detectable signal upon release from the aptamer or RNA tethered inhibitor by acting upon a substrate; or
wherein the aptamer is an inhibitory aptamer that is capable of inhibiting an enzyme and prevents the enzyme from catalyzing generation of a detectable signal from a substrate or wherein the RNA-tethered inhibitor is capable of inhibiting an enzyme and prevents the enzyme from catalyzing generation of a detectable signal from a substrate; or
wherein the aptamer is capable of sequestering a pair of agents that when released from the aptamers combine to generate a detectable signal; or
wherein the RNA-based masking construct comprises a RNA oligonucleotide with a detectable ligand on a first end of the RNA oligonucleotide and a masking component on a second end of the RNA oligonucleotide; wherein the detectable ligand is a fluorophore and the masking component is a quencher molecule.

22. The diagnostic device of claim 1, wherein said masking construct comprises a RNA oligonucleotide designed to bind a G-quadruplex forming sequence, wherein a G-quadruplex structure is formed by the G-quadruplex forming sequence upon cleavage of the masking construct, and wherein the G-quadruplex structure is capable of generating a detectable positive signal.

23. The diagnostic device of claim 1, wherein said masking construct comprises a first molecule and a second molecule and a lateral flow strip comprises two capture lines with an anti-first molecule antibody hybridized at a first capture line and an anti-second molecule antibody hybridized at a second capture line.

24. The diagnostic device of claim 23, wherein the first molecule is FITC, and the second molecule is biotin.

25. The diagnostic device of claim 1, wherein the nucleic acid amplification reagents comprise nucleic acid sequence-based amplification (NASBA), recombinase polymerase amplification (RPA), loop-mediated isothermal amplification (LAMP), strand displacement amplification (SDA), helicase-dependent amplification (HDA), nicking enzyme amplification reaction (NEAR), PCR, multiple displacement amplification (MDA), rolling circle amplification (RCA), ligase chain reaction (LCR), or ramification amplification method (RAM).

26. The diagnostic device of claim 1, further comprising a heating element, wherein the heating element is configured to heat the one or more individual discrete volumes to a predetermined temperature.

27. The diagnostic device of claim 26, wherein the heating element comprises a heating block having a groove contoured to receive and provide thermal contact with the one or more individual discrete volumes that contains the reaction mixture; wherein the heating block k configured to move; whereby the heating block may be moved to contact the discrete volume.

28. The diagnostic device of claim 1, further comprising one or more of:
a mixing element;
a pipetting dement; wherein the pipetting element is an acoustic dispenser;
at least one reservoir for storing reagents;
a cartridge capable of adding a sample and holding reagents, wherein the cartridge is removable from the device;
a fluorescence detector for real-time fluorescence-based measurement of the unmasked masking agent, if present in said reaction mixture, during operation of the device; and
a controller for operating said device; wherein the controlling means comprises a computer system, wireless computer system, smart phone, PDA, or tablet.

* * * * *

UNITED STATES PATENT AND TRADEMARK OFFICE
CERTIFICATE OF CORRECTION

PATENT NO. : 11,021,740 B2
APPLICATION NO. : 15/922837
DATED : June 1, 2021
INVENTOR(S) : Omar Abudayyeh et al.

It is certified that error appears in the above-identified patent and that said Letters Patent is hereby corrected as shown below:

In the Specification

Column No. 3, Line No. 5, "BCR-Ab1" should be -- BCR-Abl --
Column No. 3, Line No. 10, "AR1D5B" should be -- ARID5B --
Column No. 17, Line No. 28, "(targetlno" should be -- (target/no) --
Column No. 23, Line No. 31, "/j.molce1." should be -- /j.molcel. --
Column No. 23, Line No. 37, "/j.molce1." should be -- /j.molcel. --
Column No. 28, Line No. 20, "Csbl" should be -- Csb1 --
Column No. 28, Line No. 25, "Cas 1" should be -- Cas1 --
Column No. 29, Line No. 35, "In" should be -- III --
Column No. 32, Line No. 18 (approx.), "hemicellulosilytics" should be -- hemicellulosilytica --
Column No. 31-32, Line No. 11 (approx.), "7" should be -- 7) --
Column No. 31-32, Line No. 15 (approx.), "10 )(" should be -- 10) --
Column Nos. 33-34, Line No. 5 (approx.), "Leptorichia" should be -- Leptotrichia --
Column No. 36, Line No. 1, "/j.molce1." should be -- /j.molcel. --
Column No. 41, Line No. 12, "/j.molce1." should be -- /j.molcel. --
Column No. 41, Line No. 67, "(lncRNA)," should be -- (lncRNA), --
Column No. 42, Line No. 6, "lncRNA." should be -- lncRNA. --
Column No. 45, Line No. 15, "Med Chem Comm.," should be -- MedChemComm. --
Column No. 46, Line Nos. 15-16, "2'4i:1-methyl" should be -- 2'-O-methyl --
Column No. 46, Line No. 54, "21-O-methyl" should be -- 2'-O-methyl --
Column No. 46, Line No. 55, "T-deoxy" should be -- 2'-deoxy --
Column No. 47, Line No. 50, "(lncRNA)," should be -- (lncRNA), --
Column No. 47, Line No. 56, "lncRNA." should be -- lncRNA. --
Column No. 53, Line No. 39, ""MB" should be -- IIIB --
Column No. 63, Line No. 61, "a a" should be -- aa --
Column No. 65, Line No. 4, "al" should be -- al. --
Column No. 65, Line No. 11, "al" should be -- al. --
Column No. 71, Line No. 19, "Cas 13" should be -- Cas13 --
Column No. 73, Line No. 30, "13" should be -- β --

Signed and Sealed this
Thirtieth Day of May, 2023

Katherine Kelly Vidal
*Director of the United States Patent and Trademark Office*

CERTIFICATE OF CORRECTION (continued)
U.S. Pat. No. 11,021,740 B2

Column No. 80, Line No. 35, "thereof" should be -- thereof. --
Column No. 86, Line No. 24, "mmarenavirus," should be -- mammarenavirus, --
Column No. 90, Line No. 57, "(pfindr1)," should be -- pfmdr1), --
Column No. 91, Line No. 44, "Ser436A1a/" should be -- Ser436Ala/ --
Column No. 92, Line No. 35, "reference" should be -- reference. --
Column No. 93, Line No. 49, "p" should be -- β --
Column No. 94, Line Nos. 38-39, "(pfmdr 1)," should be -- pfmdr1), --
Column No. 94, Line No. 40, "(Pfinrp)," should be -- (Pfmrp), --
Column No. 97, Line No. 5 (approx.), "Cell Search®" should be -- CellSearch® --
Column No. 100, Line No. 29, "(IncRNAs)." should be -- (lncRNAs) --
Column No. 100, Line No. 30, "IncRNAs" should be -- lncRNAs --
Column No. 100, Line No. 31, "IncRNAs" should be -- lncRNAs --
Column No. 100, Line No. 45, "IncRNAs" should be -- lncRNAs --
Column No. 104, Line No. 51, "ANKLET" should be -- ANKLE1 --
Column No. 105, Line No. 49, "BCR-Ab1" should be -- BCR-Abl --
Column No. 110, Line No. 42, "Hi Scribe" should be -- HiScribe --
Column No. 110, Line No. 45, "λL" should be -- μL --
Column No. 111, Line No. 65, "10uM" should be -- 10 μM) --
Column No. 112, Line No. 32, "luL" should be -- 1 μL --
Column No. 112, Line No. 39, "37C," should be -- 37° C., --
Column No. 112, Line No 42, "500 UM," should be -- 500 μM, --
Column No. 113, Line No. 15, "-80 C" should be -- -80° C. --
Column No. 113, Line No. 26, "0.64" should be -- 0.6 μL --
Column No. 113, Line No. 40, "1; 11" should be -- 1 μL --
Column No. 118, Line No. 48, "(FIG.." should be -- FIG. --
Column No. 118, Line No. 54 (approx.), "(FIG.." should be -- (FIG. --
Column No. 120, Line No. 4, "-50 fM" should be -- ~50 fM --
Column No. 134, Line No. 24 (approx.), "1molecule/μL)" should be -- 1molecule/μL)" --
Column No. 138, Line No. 1, "Xi" should be -- X1 --
Column No. 138, Line No. 26, "TSL5-I;" should be -- TSL5-1; --